(12) United States Patent
Carr et al.

(10) Patent No.: US 7,430,476 B2
(45) Date of Patent: *Sep. 30, 2008

(54) METHOD FOR IDENTIFICATION OF T-CELL EPITOPES AND USE FOR PREPARING MOLECULES WITH REDUCED IMMUNOGENICITY

(75) Inventors: Francis J. Carr, Balmedie (GB); Graham Carter, By Newmachar (GB); Tim Jones, Babraham (GB); Stephen Williams, Insch (GB); Anita Hamilton, Aberdeen (GB)

(73) Assignee: Merck Patent GmbH, Darmstadt (DE)

( * ) Notice: Subject to any disclaimer, the term of this patent is extended or adjusted under 35 U.S.C. 154(b) by 773 days.

This patent is subject to a terminal disclaimer.

(21) Appl. No.: 10/468,496

(22) PCT Filed: Feb. 18, 2002

(86) PCT No.: PCT/EP02/01688

§ 371 (c)(1),
(2), (4) Date: Aug. 19, 2003

(87) PCT Pub. No.: WO02/069232

PCT Pub. Date: Sep. 6, 2002

(65) Prior Publication Data

US 2004/0180386 A1   Sep. 16, 2004

(30) Foreign Application Priority Data

| Feb. 19, 2001 | (EP) | ................................. 01103954 |
| Mar. 8, 2001 | (EP) | ................................. 01105777 |
| Mar. 15, 2001 | (EP) | ................................. 01106536 |
| Mar. 15, 2001 | (EP) | ................................. 01106538 |
| Mar. 20, 2001 | (EP) | ................................. 01106899 |
| Mar. 20, 2001 | (EP) | ................................. 01107012 |
| Mar. 27, 2001 | (EP) | ................................. 01107568 |
| Apr. 25, 2001 | (EP) | ................................. 01110220 |
| May 30, 2001 | (EP) | ................................. 01113228 |
| Oct. 19, 2001 | (EP) | ................................. 01124965 |
| Nov. 12, 2001 | (EP) | ................................. 01126859 |

(51) Int. Cl.
*G01N 33/48* (2006.01)
*G01N 33/50* (2006.01)
*G06F 19/00* (2006.01)
*A61K 31/385* (2006.01)

(52) U.S. Cl. ................. 702/19; 424/195.11; 424/185.1; 424/193.1

(58) Field of Classification Search .................... 702/19; 435/69.1; 424/195.11, 185.1, 193.1
See application file for complete search history.

(56) References Cited

FOREIGN PATENT DOCUMENTS

WO          98/52976     * 11/1998

OTHER PUBLICATIONS

Grandi et al Trends in Biotechnology, 19 (5), 181488, 2001.*
Doychinova et al. Immuniology and Cell Biology, 80, 270-279, 2002.*
Boehncke et al. J. Immunol, vol. 150, 331-341, No. 2, 1993.*
Gohlke et al. J. Mol. Biol., 2000, 295; pt 2, pp. 337-356).*

* cited by examiner

*Primary Examiner*—Michael Borin
(74) *Attorney, Agent, or Firm*—Olson & Cepuritis, Ltd.

(57) ABSTRACT

This invention relates to a novel approach for identification of T-cell epitopes, that give rise to an immune reaction in a living host. By means of this novel method biological compounds can be generated which have a no or at least a reduced immunogenicity when exposed to the immune system of a given species and compared with the relevant non-modified entity. Thus the invention relates also to novel biological molecules, especially proteins and antibodies, obtained by the method according to the invention.

5 Claims, 8 Drawing Sheets

METHOD FOR IDENTIFICATION OF T-CELL EPITOPES AND USE FOR PREPARING MOLECULES WITH REDUCED IMMUNOGENICITY

This application is the National Stage of International Application No. PCT/EP02/01688, filed on Feb. 18, 2002, which claims priority from European Patent Application No. 01126859.6, filed on Nov. 12, 2001, European Patent Application No. 01124965.3, filed on Oct. 19, 2001, European Patent Application No. 01113228.9, filed on May 30, 2001, European Patent Application No. 01110220.9, filed on Apr. 25, 2001, European Patent Application No. 01107568.6, filed on Mar. 27, 2001, European Patent Application No. 01106899.6, filed on Mar. 20, 2001, European Patent Application No. 01107012.5, filed on Mar. 20, 2001, European Patent Application No. 01106536.4, filed on Mar. 15, 2001, European Patent Application No. 01106538.0, filed on Mar. 15, 2001, European Patent Application No. 01105777.5, filed on Mar. 8, 2001, and European Patent Application No. 01103954.2, filed on Feb. 19, 2001.

FIELD OF INVENTION

The invention relates to a novel approach of identifying T-cell epitopes that give rise to an immune reaction in a living host comprising calculation of potential T-cell epitope values for MHC Class II molecule binding sites in a peptide by means of computer-aided methods. The invention furthermore relates to methods for preparing biological molecules, above all proteins and antibodies which elicit an immunogenic response when exposed to a host, preferably a human. By means of this method molecules can be prepared which have no or a reduced immunogenicity when exposed to the immune system of a given species and compared with the relevant non-modified entity by reduction or removal of potential T-cell epitopes within the sequence of said originally immunogenic molecules. Thus, the invention relates also to novel biological molecules obtained by the method according to the invention.

A Sequence Listing, on Compact Disc, containing the text file entitled "MER117SEQLIST.TXT", created on Sep. 25, 2003, and having a file size of 490,000 bytes, is incorporated herein by reference.

BACKGROUND OF THE INVENTION

Therapeutic use of a number of peptides, polypeptides and proteins is curtailed because of their immunogenicity in mammals, especially humans. For example, when murine antibodies are administered to patients who are not immunosuppressed, a majority of such patients exhibit an immune reaction to the introduced foreign material by making human anti-murine antibodies (HAMA) (e.g. Schroff, R. W. et al (1985) *Cancer Res.* 45: 879-885; Shawler, D. L. et al (1985) *J. Immunol.* 135: 1530-1535). There are two serious consequences. First, the patient's anti-murine antibody may bind and clear the therapeutic antibody or immunoconjugate before it has a chance to bind, for example to a tumor, and perform its therapeutic function. Second, the patient may develop an allergic sensitivity to the murine antibody and be at risk of anaphylactic shock upon any future exposure to murine immunoglobulin.

Several techniques have been employed to address the HAMA problem and thus enable the use in humans of therapeutic monoclonal antibodies (see, for example, WO-A-8909622, EP-A-0239400, EP-A-0438310, WO-A-9109967).

These recombinant DNA approaches have generally reduced the mouse genetic information in the final antibody construct whilst increasing the human genetic information in the final construct. Notwithstanding, the resultant "humanized" antibodies have, in several cases, still elicited an immune response in patients (Issacs J. D. (1990) *Sem. Immunol.* 2: 449, 456; Rebello, P. R. et al (1999) *Transplantation* 68: 1417-1420).

A common aspect of these methodologies has been the introduction into the therapeutic antibody, usually of rodent origin, of amino acid residues, even significant tracts of amino acid residue sequences, identical to those present in human antibody proteins. For antibodies, this process is possible owing to the relatively high degree of structural (and functional) conservatism among antibody molecules of different species. For potentially therapeutic peptides, polypeptides and proteins, however, where no structural homologue may exist in the host species (e.g., human) for the therapeutic protein, such processes are not applicable. Furthermore, these methods have assumed that the general introduction of a human amino acid residue sequence will render the re-modeled antibody non-immunogenic. It is known, however, that certain short peptide sequences ("T-cell epitopes") can be released during the degradation of peptides, polypeptides or proteins within cells and subsequently be presented by molecules of the major histocompatability complex (MHC) in order to trigger the activation of T-cells. For peptides presented by MHC Class II, such activation of T-cells can then give rise to an antibody response by direct stimulation of B-cells to produce such antibodies. Accordingly, it would be desirable to eliminate potential T-cell epitopes from a peptide, polypeptide or a protein. Even proteins of human origin and with the same amino acid sequences as occur within humans can still induce an immune response in humans. Notable examples include therapeutic use of granulocyte-macrophage colony stimulating factor (Wadhwa, M. et al (1999) *Clin. Cancer Res.* 5: 1353-1361) and interferon alpha 2 (Russo, D. et al (1996) *Bri. J. Haem.* 94: 300-305; Stein, R. et al (1988) *New Engl. J. Med.* 318: 1409-1413).

The elimination of T-cell epitopes from proteins has been previously disclosed (see, for example, WO 98/52976, WO 00/34317). The general methods disclosed in the prior art comprise the following steps:

(a) Determining the amino acid sequence of the polypeptide or part thereof (b) Identifying one or more potential T-cell epitopes within the amino acid sequence of the protein by any method including determination of the binding of the peptides to MHC molecules using in vitro or in silico techniques or biological assays.

(c) Designing new sequence variants with one or more amino acids within the identified potential T-cell epitopes modified in such a way to substantially reduce or eliminate the activity of the T-cell epitope as determined by the binding of the peptides to MHC molecules using in vitro or in silico techniques or biological assays. Such sequence variants are created in such a way to avoid creation of new potential T-cell epitopes by the sequence variations unless such new potential T-cell epitopes are, in turn, modified in such a way to substantially reduce or eliminate the activity of the T-cell epitope.

(d) Constructing such sequence variants by recombinant DNA techniques and testing said variants in order to identify one or more variants with desirable properties.

Other techniques exploiting soluble complexes of recombinant MHC molecules in combination with synthetic peptides and able to bind to T-cell clones from peripheral blood samples from human or experimental animal subjects have been used in the art [Kern, F. et al (1998) *Nature Medicine* 4:975-978; Kwok, W. W. et al (2001) *TRENDS in Immunology* 22: 583-588] and may also be exploited in an epitope identification strategy.

The potential T-cell epitopes are generally defined as any amino acid residue sequence with the ability to bind to MHC Class II molecules. Such potential T-cell epitopes can be measured to establish MHC binding. Implicit in the term "T-cell epitope" is an epitope which when bound to MHC molecules can be recognized by the T-cell receptor, and which can, at least in principle, cause the activation of these T-cells. It is, however, usually understood that certain peptides which are found to bind to MHC Class II molecules may be retained in a protein sequence because such peptides are tolerated by the immune within the organism into which the final protein is administered.

The invention is conceived to overcome the practical reality that soluble proteins introduced into an autologous host with therapeutic intent, can trigger an immune response resulting in development of host antibodies that bind to the soluble protein. One example amongst others is interferon alpha 2 to which a proportion of human patients make antibodies despite the fact that this protein is produced endogenously [Russo, D. et al (1996) *Brit. J. Haem.* 94: 300-305; Stein, R. et al (1988) *New Engl. J. Med.* 318: 1409-1413]

MHC Class II molecules are a group of highly polymorphic proteins which play a central role in helper T-cell selection and activation. The human leukocyte antigen group DR (HLA-DR) are the predominant isotype of this group of proteins and the major focus of the present invention. However, isotypes HLA-DQ and HLA-DP perform similar functions, hence the present invention is equally applicable to these. MHC HLA-DR molecules are homo-dimers where each "half" is a hetero-dimer consisting of $\alpha$ and $\beta$ chains. Each hetero-dimer possesses a ligand binding domain which binds to peptides varying between 9 and 20 amino acids in length, although the binding groove can accommodate a maximum of 9-11 amino acids. The ligand binding domain is comprised of amino acids 1 to 85 of the $\alpha$ chain, and amino acids 1 to 94 of the $\beta$ chain. DQ molecules have recently been shown to have an homologous structure and the DP family proteins are also expected to be very similar. In humans approximately 70 different allotypes of the DR isotype are known, for DQ there are 30 different allotypes and for DP 47 different allotypes are known. Each individual bears two to four DR alleles, two DQ and two DP alleles. The structure of a number of DR molecules has been solved and such structures point to an open-ended peptide binding groove with a number of hydrophobic pockets which engage hydrophobic residues (pocket residues) of the peptide [Brown et al *Nature* (1993) 364: 33; Stern et al (1994) *Nature* 368: 215]. Polymorphism identifying the different allotypes of class II molecule contributes to a wide diversity of different binding surfaces for peptides within the peptide binding grove and at the population level ensures maximal flexibility with regard to the ability to recognize foreign proteins and mount an immune response to pathogenic organisms.

There is a considerable amount of polymorphism within the ligand binding domain with distinct "families" within different geographical populations and ethnic groups. This polymorphism affects the binding characteristics of the peptide binding domain, thus different "families" of DR molecules will have specificities for peptides with different sequence properties, although there may be some overlap. This specificity determines recognition of Th-cell epitopes (Class II T-cell response) which are ultimately responsible for driving the antibody response to B-cell epitopes present on the same protein from which the Th-cell epitope is derived. Thus, the immune response to a protein in an individual is heavily influenced by T-cell epitope recognition which is a function of the peptide binding specificity of that individual's HLA-DR allotype. Therefore, in order to identify T-cell epitopes within a protein or peptide in the context of a global population, it is desirable to consider the binding properties of as diverse a set of HLA-DR allotypes as possible, thus covering as high a percentage of the world population as possible.

A principal factor in the induction of an immune response is the presence within the protein of peptides that can stimulate the activity of T-cell via presentation on MHC class II molecules. In order to eliminate or reduce immunogenicity, it is thus desirable to identify and remove T-cell epitopes from the protein.

The unmodified biological molecules can be produced by recombinant technologies, which are per se well known in the art, using a number of different host cell types.

However, there is a continued need for analogues of said biological molecules with enhanced properties. Desired enhancements include alternative schemes and modalities for the expression and purification of the said therapeutic, but also and especially, improvements in the biological properties of the protein. There is a particular need for enhancement of the in vivo characteristics when administered to the human subject. In this regard, it is highly desired to provide the selected biological molecule with reduced or absent potential to induce an immune response in the human subject. Such proteins would expect to display an increased circulation time within the human subject and would be of particular benefit in chronic or recurring disease settings such as is the case for a number of indications for said biological molecule.

SUMMARY OF THE INVENTION

The present invention relates, therefore, to two general aspects:

(a) a convenient and effective computational method for the identification and calculation of T-cell epitopes for a globally diverse number of MHC Class II molecules and, based on this knowledge, for designing and constructing new sequence variants of biological molecules with improved properties, and (b) novel biologically active molecules to be administered especially to humans and in particular for therapeutic use; said biological molecules are according to this invention immunogenicly modified polypeptides, proteins or immunoglobulins (antibodies) produced according to the method of the invention, whereby the modification results in a reduced propensity for the biological molecule to elicit an immune response upon administration to the human subject.

In particular the invention relates to the modification of several generally well-known proteins and antibodies with high therapeutic benefit from human or non-human origin obtained by the method according to the invention to result in proteins that are substantially non-immunogenic or less immunogenic than any non-modified counterpart when used in vivo. The molecules modified according to the novel method of this invention would expect to display an increased circulation time within the human subject and would be of particular benefit in chronic or recurring disease settings such as is the case for a number of indications. The present invention provides for, as specific embodiments and in order to demonstrate the efficacy of the inventive method, modified forms of said molecules that are expected to display enhanced properties in vivo. These molecules with modified immunogenicity, i.e. having a decreased immunogenic potential, can be used in pharmaceutical compositions. Such modified molecules are herein termed "immunogenicly" modified.

A method for identifying T-cell epitopes partially by means of computational means can be utilized to calculate theoretical T-cell epitope values and thus identify potential MHC Class II molecule binding peptides within a protein; wherein the binding site comprises a sequence of amino acid sites within the protein. The identified peptides can thereafter be modified without substantially reducing, and possibly enhancing, the therapeutic value of the protein. This computational method comprises selecting a region of the protein having a known amino acid residue sequence, sequentially sampling overlapping amino acid residue segments (windows) of predetermined uniform size and constituted by at least three amino acid residues from the selected region, calculating MHC Class II molecule binding score for each sampled segment, and identifying at least one of the sampled segments suitable for modification, based on the calculated MHC Class II molecule binding score for that segment. The overall MHC Class II binding score for the peptide can then be changed without substantially reducing therapeutic value of the protein.

The MHC Class II molecule binding score for a selected amino acid residue segment in one aspect of this invention is calculated by summing assigned values for each hydrophobic amino acid residue side chain present in the sampled amino acid residue segment of the peptide. To generate a graphical overview, the value of that sum can then be assigned to a single amino acid residue at about the midpoint of the segment. This procedure is repeated for each of the overlapping segments (windows) in the peptide region or regions of interest. The assigned value for each aromatic side chain present is about one-half of the assigned value for each hydrophobic aliphatic side chain. The hydrophobic aliphatic side chains are those present in valine, leucine, isoleucine and methionine. The aromatic side chains are those present in phenylalanine, tyrosine and tryptophan. The preferred assigned value for an aromatic side chain is about 1 and for a hydrophobic aliphatic side chain is about 2. Other values can be utilized, however.

Thus, in a first aspect, the invention provides for a computational-based method suitable for identifying one or more potential T-cell epitope peptides within the amino acid sequence of a biological molecule by steps including determination of the binding of said peptides to MHC molecules using in vitro or in silico techniques or biological assays, said method comprises the following steps:

(a) selecting a region of the peptide having a known amino acid residue sequence;
(b) sequentially sampling overlapping amino acid residue segments of predetermined uniform size and constituted by at least three amino acid residues from the selected region;
(c) calculating MHC Class II molecule binding score for each said sampled segment by summing assigned values for each hydrophobic amino acid residue side chain present in said sampled amino acid residue segment; and
(d) identifying at least one of said segments suitable for modification, based on the calculated MHC Class II molecule binding score for that segment, to change overall MIC Class II binding score for the peptide without substantially the reducing therapeutic utility of the peptide.

In a specific embodiment, the invention relates to a method, wherein step (c) is carried out by using a Böhm scoring function modified to include 12-6 van der Waal's ligand-protein energy repulsive term and ligand conformational energy term by (1) providing a first data base of MHC Class II molecule models;
(2) providing a second data base of allowed peptide backbones for said MHC Class II molecule models;
(3) selecting a model from said first data base;
(4) selecting an allowed peptide backbone from said second data base;
(5) identifying amino acid residue side chains present in each sampled segment;
(6) determining the binding affinity value for all side chains present in each sampled segment; and optionally
(7) repeating steps (1) through (5) for each said model and each said backbone.

In a further embodiment the binding score for each sampled sequence is calculated by (i) providing a first data base of MHC Class II molecule models; (ii) providing a second data base of allowed peptide backbones for said MHC Class II molecule models; (iii) providing a third database of allowed amino acid side chain conformations for each of the twenty amino acids at each position of each backbone; (iv) selecting a model from said first data base; (v) selecting an allowed peptide backbone from said second data base; (vi) identifying amino acid residue side chains present in each sampled segment together with their allowed conformations from said third database; (vii) determining the optimum binding affinity value for all side chains present in each sampled segment in each allowed conformation; (viii) repeating steps (v) through (vii) for each said backbone and determining the optimum binding score; and (ix) repeating steps (iv) through (viii) for each said model.

It should be understood that the three databases described above can be combined into one database or any two databases can be combined to provide a combined database.

The length of the amino acid residue segments to be sampled can vary. Preferably, the sampled amino acid residue segments are constituted by about 10 to about 15 amino acid residues, more preferably about 13 amino acid residues.

The sampled amino acid residue segments can be overlapping to a varying degree. Preferably, the sampled amino acid residue segments overlap substantially. Most preferably, consecutive sampled amino acid residue segments overlap one another by all but one amino acid residue.

That is, in an amino acid residue segment having n residues, n−1 residues are overlapped by the next consecutive sampled amino acid residue segment.

Thus, in more detail, the invention relates furthermore to the following further preferred embodiments:

- an accordingly specified method, wherein the assigned value for each aromatic side chain is about one-half of the assigned value for each hydrophobic aliphatic side chain;
- an accordingly specified method, wherein the sampled amino acid residue segment is constituted by 13 amino acid residues;
- an accordingly specified method, wherein consecutive sampled amino acid residue segments overlap by one to five amino acid residues;
- an accordingly specified method, wherein consecutive sampled amino acid residue segments overlap one another substantially;
- an accordingly specified method, wherein all but one of amino acid residues in consecutive sampled amino acid residue segments overlap.

In a second basic aspect, the present invention provides, modified forms of different biological molecules with one or more T-cell epitopes removed, wherein said modification may be achieved by the methods described above and in the claims. The molecules can also be produced by the methods as described in the above-cited prior art, however, the molecules obtained by the methods of this invention show enhanced properties. In the prior art teachings, predicted T-cell epitopes are removed by the use of judicious amino acid substitution within the primary sequence of the therapeutic antibody or non-antibody protein of both non-human and human derivation.

The present invention provides for modified forms of proteins and immunoglobulins that are expected to display enhanced properties in vivo.

Therefore, it is an object of the invention to provide a method for preparing an immunogenicly modified biological molecule derived from a parent molecule, wherein the modified molecule has an amino acid sequence different from that of said parent molecule and exhibits a reduced immunogenicity relative to the parent molecule when exposed to the immune system of a given species; said method comprises: (i) determining the amino acid sequence of the parent biological molecule or part thereof; (ii) identifying one or more potential T-cell epitopes within the amino acid sequence of the protein by any method including determination of the binding of the peptides to MHC molecules using in vitro or in silico techniques or biological assays, (iii) designing new sequence variants by alteration of at least one amino acid residue within the originally identified T-cell epitope sequences, said variants are modified in such a way to substantially reduce or eliminate the activity or number of the T-cell epitope sequences and/or the number of MHC allotypes able to bind peptides derived from said biological molecule as determined by the binding of the peptides to MHC molecules using in vitro or in silico techniques or biological assays or by binding of peptide-MHC complexes to T-cells, (iv) constructing such sequence variants by recombinant DNA techniques and testing said variants in order to identify one or more variants with desirable properties, and (v) optionally repeating steps (ii)-(iv), wherein the identification of T-cell epitope sequences according to step (ii) is achieved by a method as specified above and below.

Specific embodiments of step (iii) according to the invention relate to the following summarized steps:

an accordingly specified method, wherein 1-9 amino acid residues in any of the originally present T-cell epitope sequences are altered;

an accordingly specified method, wherein one amino acid residues in any of the originally present T-cell epitope sequences is altered;

an accordingly specified method, wherein the amino acid alteration is made with reference to an homologous protein sequence and or to in silico modeling techniques.

an accordingly specified method, wherein the alteration of the amino acid residues is substitution, deletion or addition of originally present amino acid(s) residue(s) by other amino acid residue(s) at specific position(s).

an accordingly specified method, wherein additionally further alteration, preferably by substitution, addition or deletion of specific amino acid(s), is conducted to restore biological activity of said biological molecule.

With the exception of step (ii) the other steps of the method disclosed can be achieved by methods and techniques which are well known for skilled workers. Since the modified biological molecules are prepared preferably by recombinant technologies corresponding DNA constructs which were deduced from the amino acid sequence after having completed the exchange of amino acid residues identified by the method of step (i). The recombinant techniques used herein are well known in the art (e.g. Sambrook et al., 1989, Molecular Cloning, A Laboratory Manual, Cold Spring Harbor Laboratory Press, NY, USA).

The biological molecule obtained according to the invention is preferably a peptide, a protein, an antibody, an antibody fragment, or a fusion protein. The invention includes furthermore modifications, variants, mutations, fragments, derivatives, non-, partially- or completely glycosylated forms of said molecules having the same or similar biological and/or pharmacological activity.

Although the method disclosed in this invention is not limited to specific biological molecules, it is a specific embodiment of the invention to provide preferably molecules which are known in the art and show a therapeutic benefit and value. Thus it is a further object of the invention to provide an immunogenicly modified biological molecule derived from a parent molecule, wherein the modified molecule has an amino acid sequence different from that of said parent molecule and exhibits a reduced immunogenicity relative to the parent molecule when exposed to the immune system of a given species, obtained by a method according to the invention as disclosed in detail above and below.

The biological molecules of special interest obtained by said method are selected from the groups:

(a) monoclonal antibodies:
anti-40 kD glycoprotein antigen antibody KS ¼,
anti-GD2 antibody 14.18
anti-Her2 antibody 4D5 (murine) and humanized version (Herceptin®),
anti-Her1 (EGFR) antibody c225 and h425
anti-IL-2R (anti-Tac) antibody (Zenapax®),
anti-CD52 antibody (CAMPATH®);
anti-CD20 antibodies (C2B8, Rituxan®; Bexxar®)
antibody directed to the human C5 complement protein (b) human proteins:
sTNF-R1, sTNF-R2, sTNFR-Fc (Enbrel®),
protein C, acrp30, ricin A, CNTFR ligands
subtilisin, GM-CSF, human follicle stimulating hormone (h-fsh)
β-glucocerebrosidase, GLP-1, apolipoprotein A1,
leptin (human obesity protein), KGF, G-CSF,
BDNF, EPO, Il-1R antagonist.

The third basic aspect of the present invention relates to the T-cell epitope sequences that derive from the parent immunogenicly non-modified biological molecules. These epitopes are preferably 13mer petides. Within these peptides sequences having 9 consecutive amino acid residues are preferred. Thus it is another object of the invention to provide access to such epitopes and sequences. In more detail the invention relates to:

a use of a potential T-cell epitope peptide within the amino acid sequence of a parent immunogenicly non-modified biological molecule identified according to any of the methods as described for preparing a biological molecule with reduced immunogenicity having the same biological activity;

a corresponding use of a potential T-cell epitope peptide, wherein said T-cell epitope is a 13mer peptide;

a use of a peptide sequence consisting of at least 9 consecutive amino acid residues of a 13mer T-cell epitope as specified above for preparing a biological molecule with reduced immunogenicity having the same biological activity as compared with the parent non-modified molecule.

DETAILED DESCRIPTION OF THE INVENTION

Figure 1:
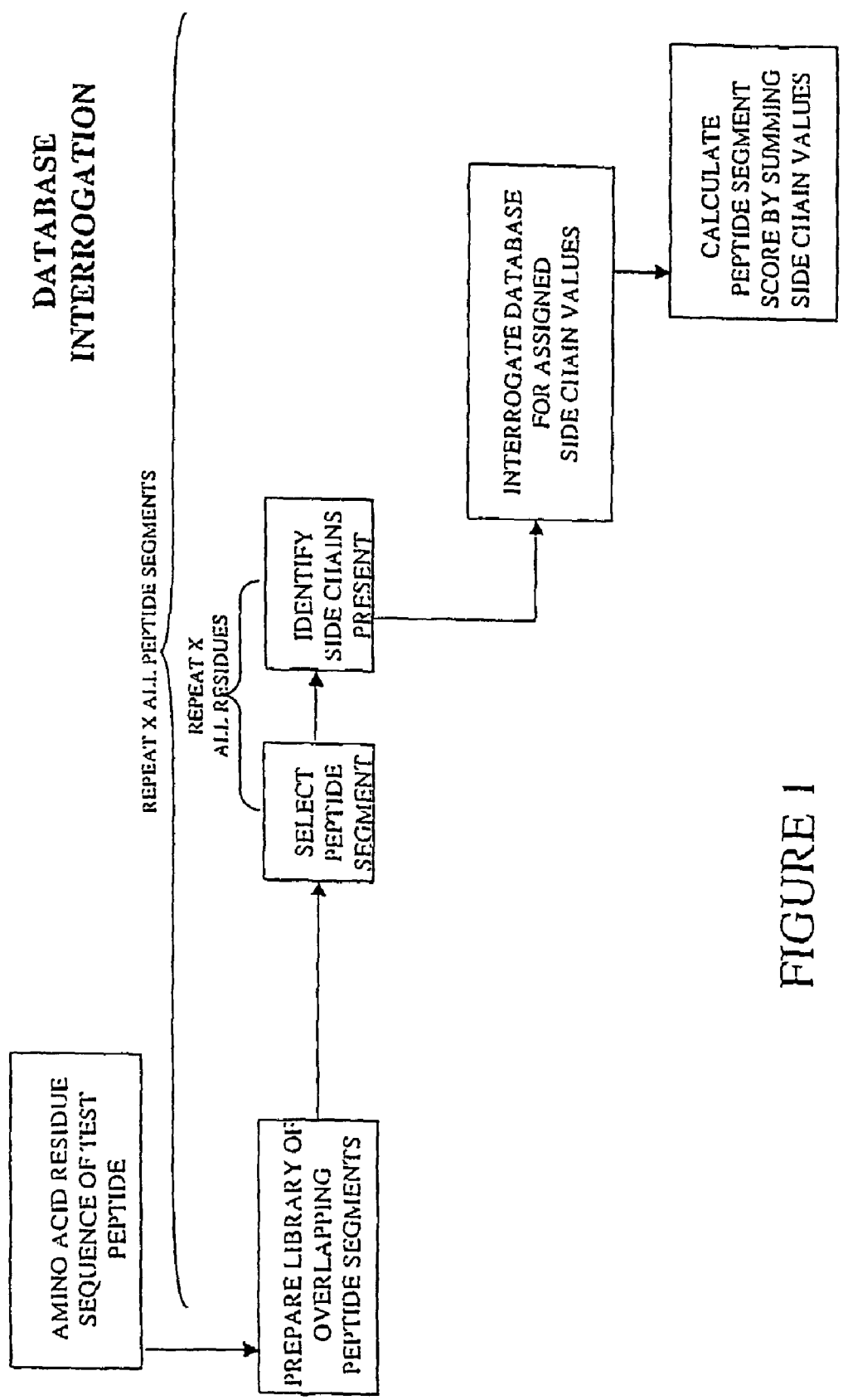
FIG. 1 is a flow chart illustrating one aspect of the present computational method.

The term "T-cell epitope" means according to the understanding of this invention an amino acid sequence which is able to bind with reasonable efficiency MHC class II molecules (or their equivalent in a non-human species), able to stimulate T-cells and/or also to bind (without necessarily measurably activating) T-cells in complex with MHC class II. The term "peptide" as used herein and in the appended claims, is a compound that includes two or more amino acids. The amino acids are linked together by a peptide bond (defined herein below). There are 20 different naturally occurring amino acids involved in the biological production of peptides, and any number of them may be linked in any order to form a peptide chain or ring. The naturally occurring amino acids employed in the biological production of peptides all have the L-configuration. Synthetic peptides can be prepared employing conventional synthetic methods, utilizing L-amino acids, D-amino acids, or various combinations of amino acids of the two different configurations. Some peptides contain only a few amino acid units. Short peptides, e.g., having less than ten amino acid units, are sometimes referred to as "oligopeptides". Other peptides contain a large number of amino acid residues, e.g. up to 100 or more, and are referred to as "polypeptides". By convention, a "polypeptide" may be considered as any peptide chain containing three or more amino acids, whereas a "oligopeptide" is usually considered as a particular type of "short" polypeptide. Thus, as used herein, it is understood that any reference to a "polypeptide" also includes an oligopeptide. Further, any reference to a "peptide" includes polypeptides, oligopeptides, and proteins. Each different arrangement of amino acids forms different polypeptides or proteins. The number of polypeptides—and hence the number of different proteins—that can be formed is practically unlimited.

The term "less or reduced immunogenic(ity)" used before and thereafter is a relative term and relates to the immunogenicity of the respective original source molecule when exposed in vivo to the same type of species compared with the molecule modified according to the invention. The term "modified protein" as used according to this invention describes a protein which has reduced number of T-cell epitopes and elicits therefore a reduced immunogenicity relative to the parent protein when exposed to the immune system of a given species. The term "non-modified protein" as used according to this invention describes the "parent" protein as compared to the "modified protein" and has a larger number of T-cell epitopes and, therefore, an enhanced immunogenicity relative to the modified protein when exposed to the immune system of a given species.

"Alpha carbon (Cα)" is the carbon atom of the carbon-hydrogen (CH) component that is in the peptide chain. A "side chain" is a pendant group to Cα that can comprise a simple or complex group or moiety, having physical dimensions that can vary significantly compared to the dimensions of the peptide.

T-cell epitopes can be identified by the computational method of the current invention by consideration of amino acid residues important for the binding of a particular T-cell epitope to MHC Class II molecules. Once identified, potential T-cell epitopes can be removed or obliterated from an amino acid residue sequence by alteration, such as mutation, of key amino acid residues in that sequence. Any modification made to the sequence of a peptide in a region which is likely to contain T-cell epitopes, by deletion, addition or substitution, resulting in a relatively lower overall binding score will have the effect of rendering the amino acid residue sequence less immunogenic. In some instances, it may be desirable to enhance the binding of certain peptides to MHC Class II molecules. For example, it has been proposed that tolerance to certain autoantigens can be reinstated in individuals suffering from autoimmune disease if such individuals are treated with peptide analogues of regions of the autoantigen that are known to contain T-cell epitopes. The natural epitope usually has moderate affinity for MHC Class II molecules, whereas the peptide analogue is made such that it has a relatively higher affinity for MHC Class II molecules. This high affinity is important in either promoting immune surveillance to clear such T-cells presenting this high affinity epitope, or for them to become anergised. This modification to a T-cell epitope can also be made at the protein level of the peptide, and the entire protein administered as a therapeutic. There are a number of factors that play important roles in determining the total structure of a protein or polypeptide. First, the peptide bond, i.e., that bond which joins the amino acids in the chain together, is a covalent bond. This bond is planar in structure, essentially a substituted amide. An "amide" is any of a group of organic compounds containing the grouping:

The planar peptide bond linking Cα of adjacent amino acids may be represented as depicted below:

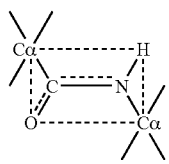

Because the O=C and the C—N atoms lie in a relatively rigid plane, free rotation does not occur about these axes.

Hence, a plane schematically depicted by the interrupted line is sometimes referred to as an "amide" or "peptide plane" plane wherein lie the oxygen (O), carbon (C), nitrogen (N), and hydrogen (H) atoms of the peptide backbone. At opposite corners of this amide plane are located the Cα atoms. Since there is substantially no rotation about the O═C and C—N atoms in the peptide or amide plane, a polypeptide chain thus comprises a series of planar peptide linkages joining the Cα atoms.

A second factor that plays an important role in defining the total structure or conformation of a polypeptide or protein is the angle of rotation of each amide plane about the common Cα linkage. The terms "angle of rotation" and "torsion angle" are hereinafter regarded as equivalent terms. Assuming that the O, C, N, and H atoms remain in the amide plane (which is usually a valid assumption, although there may be some slight deviations from planarity of these atoms for some conformations), these angles of rotation define the N and R polypeptide's backbone conformation, i.e., the structure as it exists between adjacent residues. These two angles are known as φ and ψ. A set of the angles $\phi_1$, $\psi_1$, where the subscript i represents a particular residue of a polypeptide chain, thus effectively defines the polypeptide The conventions used in defining the φ, ψ angles, i.e., the reference points at which the amide planes form a zero degree angle, and the definition of which angle is φ, and which angle is ψ, for a given polypeptide, are defined in the literature. See, e.g., Ramachandran et al. *Adv. Prot. Chem.* 23:283-437 (1968), at pages 285-94, which pages are incorporated herein by reference.

The present method can be applied to any protein, and is based in part upon the discovery that in humans the primary Pocket 1 anchor position of MHC Class II molecule binding grooves has a well designed specificity for particular amino acid side chains. The specificity of this pocket is determined by the identity of the amino acid at position 86 of the beta chain of the MHC Class II molecule. This site is located at the bottom of Pocket 1 and determines the size of the side chain that can be accommodated by this pocket (Marshall, K. W., (1994), *J. Immunol.* 152:4946-4956). If this residue is a glycine, then all hydrophobic aliphatic and aromatic amino acids (hydrophobic aliphatics being: valine, leucine, isoleucine, methionine and aromatics being: phenylalanine, tyrosine and tryptophan) can be accommodated in the pocket, a preference being for the aromatic side chains. If this pocket residue is a valine, then the side chain of this amino acid protrudes into the pocket and restricts the size of peptide side chains that can be accommodated such that only hydrophobic aliphatic side chains can be accommodated. Therefore, in an amino acid residue sequence, wherever an amino acid with a hydrophobic aliphatic or aromatic side chain is found, there is the potential for a MHC Class II restricted T-cell epitope to be present. If the side-chain is hydrophobic aliphatic, however, it is approximately twice as likely to be associated with a T-cell epitope than an aromatic side chain (assuming an approximately even distribution of Pocket 1 types throughout the global population).

A computational method embodying the present invention profiles the likelihood of peptide regions to contain T-cell epitopes as follows:

(1) The primary sequence of a peptide segment of predetermined length is scanned, and all hydrophobic aliphatic and aromatic side chains present are identified. (2) The hydrophobic aliphatic side chains are assigned a value greater than that for the aromatic side chains; preferably about twice the value assigned to the aromatic side chains, e.g., a value of 2 for a hydrophobic aliphatic side chain and a value of 1 for an aromatic side chain. (3) The values determined to be present are summed for each overlapping amino acid residue segment (window) of predetermined uniform length within the peptide, and the total value for a particular segment (window) is assigned to a single amino acid residue at an intermediate position of the segment (window), preferably to a residue at about the midpoint of the sampled segment (window). This procedure is repeated for each sampled overlapping amino acid residue segment (window). Thus, each amino acid residue of the peptide is assigned a value that relates to the likelihood of a T-cell epitope being present in that particular segment (window). (4) The values calculated and assigned as described in Step 3, above, can be plotted against the amino acid coordinates of the entire amino acid residue sequence being assessed. (5) All portions of the sequence which have a score of a predetermined value, e.g., a value of 1, are deemed likely to contain a T-cell epitope and can be modified, if desired.

This particular aspect of the present invention provides a general method by which the regions of peptides likely to contain T-cell epitopes can be described. Modifications to the peptide in these regions have the potential to modify the MHC Class II binding characteristics.

According to another aspect of the present invention, T-cell epitopes can be predicted with greater accuracy by the use of a more sophisticated computational method which takes into account the interactions of peptides with models of MHC Class II alleles.

The computational prediction of T-cell epitopes present within a peptide according to this particular aspect contemplates the construction of models of at least 42 MHC Class II alleles based upon the structures of all known MHC Class II molecules and a method for the use of these models in the computational identification of T-cell epitopes, the construction of libraries of peptide backbones for each model in order to allow for the known variability in relative peptide backbone alpha carbon (Cα) positions, the construction of libraries of amino-acid side chain conformations for each backbone dock with each model for each of the 20 amino-acid alternatives at positions critical for the interaction between peptide and MHC Class II molecule, and the use of these libraries of backbones and side-chain conformations in conjunction with a scoring function to select the optimum backbone and side-chain conformation for a particular peptide docked with a particular MHC Class II molecule and the derivation of a binding score from this interaction. Models of MHC Class II molecules can be derived via homology modeling from a number of similar structures found in the Brookhaven Protein Data Bank ("PDB"). These may be made by the use of semi-automatic homology modeling software (Modeller, Sali A. & Blundell T L., 1993. *J. Mol. Biol.* 234: 779-815) which incorporates a simulated annealing function, in conjunction with the CHARMm force-field for energy minimisation (available from Molecular Simulations Inc., San Diego, Calif.). Alternative modeling methods can be utilized as well.

The present method differs significantly from other computational methods which use libraries of experimentally derived binding data of each amino-acid alternative at each position in the binding groove for a small set of MHC Class II molecules (Marshall, K. W., et al., *Biomed. Pept. Proteins Nucleic Acids,* 1(3): 157-162 (1995) or yet other computational methods which use similar experimental binding data in order to define the binding characteristics of particular types of binding pockets within the groove, again using a relatively small subset of MHC Class II molecules, and then 'mixing and matching' pocket types from this pocket library to artificially create further 'virtual' MHC Class II molecules (Sturniolo T., et al., *Nat. Biotech,* 17(6): 555-561 (1999). Both prior methods suffer the major disadvantage that, due to the complexity of the assays and the need to synthesize large numbers of peptide variants, only a small number of MHC Class II molecules can be experimentally scanned. Therefore the first prior method can only make predictions for a small number of MHC Class II molecules. The second prior method also makes the assumption that a pocket lined with similar amino-acids in one molecule will have the same binding characteristics when in the context of a different Class II allele and suffers further disadvantages in that only those MHC Class II molecules can be 'virtually' created which contain pockets contained within the pocket library. Using the modeling approach described herein, the structure of any number and type of MHC Class II molecules can be deduced, therefore alleles can be specifically selected to be representative of the global population. In addition, the number of MHC Class II molecules scanned can be increased by making further models further than having to generate additional data via complex experimentation.

The use of a backbone library allows for variation in the positions of the $C\alpha$ atoms of the various peptides being scanned when docked with particular MHC Class II molecules. This is again in contrast to the alternative prior computational methods described above which rely on the use of simplified peptide backbones for scanning amino-acid binding in particular pockets. These simplified backbones are not likely to be representative of backbone conformations found in 'real' peptides leading to inaccuracies in prediction of peptide binding. The present backbone library is created by superposing the backbones of all peptides bound to MHC Class II molecules found within the Protein Data Bank and noting the root mean square (RMS) deviation between the $C\alpha$ atoms of each of the eleven amino-acids located within the binding groove. While this library can be derived from a small number of suitable available mouse and human structures (currently 13), in order to allow for the possibility of even greater variability, the RMS figure for each C"-position is increased by 50%. The average $C\alpha$ position of each amino-acid is then determined and a sphere drawn around this point whose radius equals the RMS deviation at that position plus 50%. This sphere represents all allowed $C\alpha$ positions.

Working from the $C\alpha$ with the least RMS deviation (that of the amino-acid in Pocket 1 as mentioned above, equivalent to Position 2 of the 11 residues in the binding groove), the sphere is three-dimensionally gridded, and each vertex within the grid is then used as a possible location for a $C\alpha$ of that amino-acid. The subsequent amide plane, corresponding to the peptide bond to the subsequent amino-acid is grafted onto each of these $C\alpha$s and the $\phi$ and $\psi$ angles are rotated step-wise at set intervals in order to position the subsequent $C\alpha$. If the subsequent $C\alpha$ falls within the 'sphere of allowed positions' for this $C\alpha$ than the orientation of the dipeptide is accepted, whereas if it falls outside the sphere then the dipeptide is rejected. This process is then repeated for each of the subsequent $C\alpha$ positions, such that the peptide grows from the Pocket 1 $C\alpha$ 'seed', until all nine subsequent $C\alpha$s have been positioned from all possible permutations of the preceding $C\alpha$s. The process is then repeated once more for the single $C\alpha$ preceding pocket 1 to create a library of backbone $C\alpha$ positions located within the binding groove.

The number of backbones generated is dependent upon several factors: The size of the "spheres of allowed positions"; the fineness of the gridding of the "primary sphere" at the Pocket 1 position; the fineness of the step-wise rotation of the $\phi$ and $\psi$ angles used to position subsequent $C\alpha$s. Using this process, a large library of backbones can be created. The larger the backbone library, the more likely it will be that the optimum fit will be found for a particular peptide within the binding groove of an MHC Class II molecule. Inasmuch as all backbones will not be suitable for docking with all the models of MHC Class II molecules due to clashes with amino-acids of the binding domains, for each allele a subset of the library is created comprising backbones which can be accommodated by that allele. The use of the backbone library, in conjunction with the models of MHC Class II molecules creates an exhaustive database consisting of allowed side chain conformations for each amino-acid in each position of the binding groove for each MHC Class II molecule docked with each allowed backbone. This data set is generated using a simple steric overlap function where a MHC Class II molecule is docked with a backbone and an amino-acid side chain is grafted onto the backbone at the desired position. Each of the rotatable bonds of the side chain is rotated step-wise at set intervals and the resultant positions of the atoms dependent upon that bond noted. The interaction of the atom with atoms of side-chains of the binding groove is noted and positions are either accepted or rejected according to the following criteria: The sum total of the overlap of all atoms so far positioned must not exceed a pre-determined value. Thus the stringency of the conformational search is a function of the interval used in the step-wise rotation of the bond and the pre-determined limit for the total overlap. This latter value can be small if it is known that a particular pocket is rigid, however the stringency can be relaxed if the positions of pocket side-chains are known to be relatively flexible. Thus allowances can be made to imitate variations in flexibility within pockets of the binding groove. This conformational search is then repeated for every amino-acid at every position of each backbone when docked with each of the MHC Class II molecules to create the exhaustive database of side-chain conformations.

A suitable mathematical expression is used to estimate the energy of binding between models of MHC Class II molecules in conjunction with peptide ligand conformations which are empirically derived by scanning the large database of backbone/side-chain conformations described above. Thus a protein is scanned for potential T-cell epitopes by subjecting each possible peptide of length varying between 9 and 20 amino-acids (although the length is kept constant for each scan) to the, following computations: an MHC Class II molecule is selected together with a peptide backbone allowed for that molecule and the side-chains corresponding to the desired peptide sequence are grafted on. Atom identity and interatomic distance data relating to a particular side-chain at a particular position on the backbone are collected for each allowed conformation of that amino-acid (obtained from the database described above). This is repeated for each side-chain along the backbone and peptide scores derived using a scoring function. The best score for that backbone is retained and the process repeated for each allowed backbone for the selected model. The scores from all allowed backbones are compared and the highest score is deemed to be the peptide score for the desired peptide in that MHC Class II model. This process is then repeated for each model with every possible peptide derived from the protein being scanned, and the scores for peptides versus models are displayed.

In the context of the present invention, each ligand presented for the binding affinity calculation is an amino-acid segment selected from a peptide or protein as discussed above. Thus, the ligand is a selected stretch of amino acids about 9 to 20 amino acids in length derived from a peptide, polypeptide or protein of known sequence. The terms "amino acids" and "residues" are hereinafter regarded as equivalent terms. The ligand, in the form of the consecutive amino acids of the peptide to be examined grafted onto a backbone from the backbone library, is positioned in the binding cleft of an MHC Class II molecule from the MHC Class II molecule model library via the coordinates of the C"-atoms of the peptide backbone and an allowed conformation for each side-chain is selected from the database of allowed conformations. The relevant atom identities and interatomic distances are also retrieved from this database and used to calculate the peptide binding score. Ligands with a high binding affinity for the MHC Class II binding pocket are flagged as candidates for site-directed mutagenesis. Amino-acid substitutions are made in the flagged ligand (and hence in the protein of interest) which is then retested using the scoring function in order to determine changes which reduce the binding affinity below a predetermined threshold value. These changes can then be incorporated into the protein of interest to remove T-cell epitopes.

Binding between the peptide ligand and the binding groove of MHC Class II molecules involves non-covalent interactions including, but not limited to: hydrogen bonds, electrostatic interactions, hydrophobic (lipophilic) interactions and Van der Waals interactions. These are included in the peptide scoring function as described in detail below. It should be understood that a hydrogen bond is a non-covalent bond which can be formed between polar or charged groups and consists of a hydrogen atom shared by two other atoms. The hydrogen of the hydrogen donor has a positive charge where the hydrogen acceptor has a partial negative charge. For the purposes of peptide/protein interactions, hydrogen bond donors may be either nitrogens with hydrogen attached or hydrogens attached to oxygen or nitrogen. Hydrogen bond acceptor atoms may be oxygens not attached to hydrogen, nitrogens with no hydrogens attached and one or two connections, or sulphurs with only one connection. Certain atoms, such as oxygens attached to hydrogens or imine nitrogens (e.g. C═NH) may be both hydrogen acceptors or donors. Hydrogen bond energies range from 3 to 7 Kcal/mol and are much stronger than Van der Waal's bonds, but weaker than covalent bonds. Hydrogen bonds are also highly directional and are at their strongest when the donor atom, hydrogen atom and acceptor atom are co-linear. Electrostatic bonds are formed between oppositely charged ion pairs and the strength of the interaction is inversely proportional to the square of the distance between the atoms according to Coulomb's law. The optimal distance between ion pairs is about 2.8 Å. In protein/peptide interactions, electrostatic bonds may be formed between arginine, histidine or lysine and aspartate or glutamate. The strength of the bond will depend upon the pKa of the ionizing group and the dielectric constant of the medium although they are approximately similar in strength to hydrogen bonds.

Lipophilic interactions are favorable hydrophobic-hydrophobic contacts that occur between he protein and peptide ligand. Usually, these will occur between hydrophobic amino acid side chains of the peptide buried within the pockets of the binding groove such that they are not exposed to solvent. Exposure of the hydrophobic residues to solvent is highly unfavorable since the surrounding solvent molecules are forced to hydrogen bond with each other forming cage-like clathrate structures. The resultant decrease in entropy is highly unfavorable. Lipophilic atoms may be sulphurs that are neither polar nor hydrogen acceptors and carbon atoms that are not polar.

Van der Waal's bonds are non-specific forces found between atoms which are 3-4 Å apart. They are weaker and less specific than hydrogen and electrostatic bonds. The distribution of electronic charge around an atom changes with time and, at any instant, the charge distribution is not symmetric. This transient asymmetry in electronic charge induces a similar asymmetry in neighboring atoms. The resultant attractive forces between atoms reaches a maximum at the Van der Waal's contact distance but diminishes very rapidly at about 1 Å to about 2 Å. Conversely, as atoms become separated by less than the contact distance, increasingly strong repulsive forces become dominant as the outer electron clouds of the atoms overlap. Although the attractive forces are relatively weak compared to electrostatic and hydrogen bonds (about 0.6 Kcal/mol), the repulsive forces in particular may be very important in determining whether a peptide ligand may bind successfully to a protein.

In one embodiment, the Böhm scoring function (SCORE1 approach) is used to estimate the binding constant. (Böhm, H. J., *J. Comput. Aided Mol. Des.* 8(3):243-256 (1994) which is hereby incorporated in its entirety). In another embodiment, the scoring function (SCORE2 approach) is used to estimate the binding affinities as an indicator of a ligand containing a T-cell epitope (Böhm, H. J., *J. Comput. Aided Mol. Des.* 12(4):309-323 (1998) which is hereby incorporated in its entirety). However, the Böhm scoring functions as described in the above references are used to estimate the binding affinity of a ligand to a protein where it is already known that the ligand successfully binds to the protein and the protein/ligand complex has had its structure solved, the solved structure being present in the Protein Data Bank ("PDB"). Therefore, the scoring function has been developed with the benefit of known positive binding data. To allow for discrimination between positive and negative binders, a repulsion term can optionally be added to the equation. In addition, a more satisfactory estimate of binding energy is achieved by computing the lipophilic interactions in a pairwise manner rather than using the area based energy term of the above Böhm functions. Therefore, in a preferred embodiment, the binding energy is estimated using a modified Böhm scoring function. In the modified Böhm scoring function, the binding energy between protein and ligand ($\Delta G_{bind}$) is estimated considering the following parameters: The reduction of binding energy due to the overall loss of translational and rotational entropy of the ligand ($\Delta G_0$); contributions from ideal hydrogen bonds ($\Delta G_{hb}$) where at least one partner is neutral; contributions from unperturbed ionic interactions ($\Delta G_{ionic}$); lipophilic interactions between lipophilic ligand atoms and lipophilic acceptor atoms ($\Delta G_{lipo}$); the loss of binding energy due to the freezing of internal degrees of freedom in the ligand, i.e., the freedom of rotation about each C—C bond is reduced ($\Delta G_{rot}$); the energy of the interaction between the protein and ligand ($E_{VdW}$). Consideration of these terms gives equation 1:

$$(\Delta G_{bind})=(\Delta G_0)+(\Delta G_{hb}\times N_{hb})+(\Delta G_{ionic}\times N_{ionic})+(\Delta G_{lipo}\times N_{lipo})+(\Delta G_{rot}+N_{rot})+(E_{VdW}).$$

Where N is the number of qualifying interactions for a specific term and, in one embodiment, $\Delta G_0$, $\Delta G_{hb}$, $\Delta G_{ionic}$, $\Delta G_{lipo}$ and $\Delta G_{rot}$ are constants which are given the values: 5.4, −4.7, −4.7, −0.17, and 1.4, respectively.

The term $N_{hb}$ is calculated according to equation 2:

$$N_{hb}=\Sigma_{h\text{-}bonds}f(\Delta R, \Delta\alpha)\times f(N_{neighb})\times f_{pcs}$$

$f(\Delta R, \Delta\alpha)$ is a penalty function which accounts for large deviations of hydrogen bonds from ideality and is calculated according to equation 3:

$$f(\Delta R, \Delta-)=f1(\Delta R)\times f2(\Delta\alpha)$$

Where: $f1(\Delta R)=1$ if $\Delta R<=TOL$
or $=1-(\Delta R-TOL)/0.4$ if $\Delta R<=0.4+TOL$
or ═O if AR>0.4+TOL And: $f2(\Delta\alpha)=1$ if $\Delta\alpha<30°$
or $=1-(\Delta\alpha-30)/50$ if $\Delta\alpha<=80°$
or $=0$ if $\Delta\alpha>80°$ TOL is the tolerated deviation in hydrogen bond length=0.25 Å

$\Delta R$ is the deviation of the H—O/N hydrogen bond length from the ideal value=1.9 Å

$\Delta\alpha$ is the deviation of the hydrogen bond angle $\angle_{N/O—H...O/N}$ from its idealized value of 180° $f(N_{neighb})$ distinguishes between concave and convex parts of a protein surface and therefore assigns greater weight to polar interactions found in pockets rather than those found at the protein surface. This function is calculated according to equation 4 below:

$$f(N_{neighb})=(N_{neighb}/N_{neighb,0})^\alpha \text{ where } \alpha=0.5$$

$N_{neighb}$ is the number of non-hydrogen protein atoms that are closer than 5 Å to any given protein atom.

$N_{neighb,0}$ is a constant=25

$f_{pcs}$ is a function which allows for the polar contact surface area per hydrogen bond and therefore distinguishes between strong and weak hydrogen bonds and its value is determined according to the following criteria:

$f_{pcs}=\beta$ when $A_{polar}/N_{HB}<10$ Å$^2$
or $f_{pcs}=1$ when $A_{polar}/N_{HB}>10$ Å$^2$ $A_{polar}$ is the size of the polar protein-ligand contact surface
$N_{HB}$ is the number of hydrogen bonds
$\beta$ is a constant whose value=1.2

For the implementation of the modified Böhm scoring function, the contributions from ionic interactions, $\Delta G_{ionic}$, are computed in a similar fashion to those from hydrogen bonds described above since the same geometry dependency is assumed.

The term $N_{lipo}$ is calculated according to equation 5 below:

$$N_{lipo}=\Sigma_{1L}f(r_{1L})$$

$f(r_{1L})$ is calculated for all lipophilic ligand atoms, 1, and all lipophilic protein atoms, L, according to the following criteria:

$f(r_{1L})=1$ when $r_{1L}<=R1$ $f(r_{1L})=(r_{1L}-R1)/(R2-R1)$ when $R2<r_{1L}>R1$
$f(r_{1L})=0$ when $r_{1L}>=R2$ Where: $R1=r_1^{vdw}+r_L^{vdw}+0.5$ and $R2=R1+3.0$ and $r_1^{vdw}$ is the Van der Waal's radius of atom 1 and $r_L^{vdw}$ is the Van der Waal's radius of atom L

The term $N_{rot}$ is the number of rotatable bonds of the amino acid side chain and is taken to be the number of acyclic $sp^3$-$sp^3$ and $Sp3$-$Sp2$ bonds. Rotations of terminal —CH$_3$ or —NH$_3$ are not taken into account.

The final term, $E_{VdW}$, is calculated according to equation 6 below:

$$E_{VdW}=\epsilon_1\epsilon_2((r_1^{vdw}+r_2^{vdw})^{12}/r^{12}-(r_1^{vdw}+r_2^{vdw})^6/r^6),$$
where:

$\epsilon_1$ and $\epsilon_2$ are constants dependant upon atom identity
$r_1^{vdw}+r_2^{vdw}$ are the Van der Waal's atomic radii
r is the distance between a pair of atoms.

With regard to equation 6, in one embodiment, the constants $\epsilon_1$ and $\epsilon_2$ are given the atom values: C: 0.245, N: 0.283, O: 0.316, S: 0.316, respectively (i.e. for atoms of Carbon, Nitrogen, Oxygen and Sulphur, respectively). With regards to equations 5 and 6, the Van der Waal's radii are given the atom values C: 1.85, N: 1.75, O: 1.60, S: 2.00 Å.

It should be understood that all predetermined values and constants given in the equations above are determined within the constraints of current understandings of protein ligand interactions with particular regard to the type of computation being undertaken herein. Therefore, it is possible that, as this scoring function is refined further as a result of progress in the field of modeling of molecular interactions, these values and constants may change hence any suitable numerical value that gives the desired results in terms of estimating the binding energy of a protein to a ligand may be used and thus fall within the scope of the present invention.

As described above, the scoring function is applied to data extracted from the database of side-chain conformations, atom identities, and interatomic distances. For the purposes of the present description, the number of MHC Class II molecules included in this database is 42 models plus four solved structures. It should be apparent from the above descriptions that the modular nature of the construction of the computational method of the present invention means that new models can simply be added and scanned with the peptide backbone library and side-chain conformational search function to create additional data sets which can be processed by the peptide scoring function as described above. This allows for the repertoire of scanned MHC Class II molecules to easily be increased, or structures and associated data to be replaced if data are available to create more accurate models of the existing alleles.

It should be understood that, although the above scoring function is relatively simple compared to some sophisticated methodologies that are available, the calculations are performed extremely rapidly. It should also be understood that the objective is not to calculate the true binding energy per se for each peptide docked in the binding groove of a selected MHC Class II protein. The underlying objective is to obtain comparative binding energy data as an aid to predicting the location of T-cell epitopes based on the primary structure (i.e. amino acid sequence) of a selected protein. A relatively high binding energy or a binding energy above a selected threshold value would suggest the presence of a T-cell epitope in the ligand. The ligand may then be subjected to at least one round of amino-acid substitution and the binding energy recalculated. Due to the rapid nature of the calculations, these manipulations of the peptide sequence can be performed interactively within the program's user interface on cost-effectively available computer hardware. Major investment in computer hardware is thus not required.

It would be apparent to one skilled in the art that other available software could be used for the same purposes. In particular, more sophisticated software which is capable of docking ligands into protein binding-sites may be used in conjunction with energy minimization. Examples of docking software are: DOCK (Kuntz et al., *J. Mol. Biol.* 161:269-288 (1982)), LUDI (Böhm, H. J., *J. Comput. Aided Mol. Des.* 8:623-632 (1994)) and FLEXX (Rarey M., et al., *ISMB*, 3: 300-308 (1995)). Examples of molecular modeling and manipulation software include: AMBER (Tripos) and CHARMm (Molecular Simulations Inc.). The use of these computational methods would severely limit the throughput of the method of this invention due to the lengths of processing time required to make the necessary calculations. However, it is feasible that such methods could be used as a 'secondary screen' to obtain more accurate calculations of binding energy for peptides which are found to be 'positive binders' via the method of the present invention.

The limitation of processing time for sophisticated molecular mechanic or molecular dynamic calculations is one which is defined both by the design of the software which makes these calculations and the current technology limitations of computer hardware. It may be anticipated that, in the future, with the writing of more efficient code and the continuing increases in speed of computer processors, it may become feasible to make such calculations within a more manageable time-frame. Further information on energy functions applied to macromolecules and consideration of the various interactions that take place within a folded protein structure can be found in: Brooks, B. R., et al., *J. Comput. Chem.* 4:187-217 (1983) and further information concerning general protein-ligand interactions can be found in: Dauber-Osguthorpe et al., *Proteins* 4(1):31-47 (1988), which are incorporated herein by reference in their entirety. Useful background information can also be found, for example, in Fasman, G. D., ed., *Prediction of Protein Structure and the Principles of Protein Conformation*, Plenum Press, New York, ISBN: 0-306 4313-9.

The present prediction method can be calibrated against a data set comprising a large number of peptides whose affinity for various MHC Class II molecules has previously been experimentally determined.

According to a preferred embodiment of the method, any one of the specific prediction methods described herein, or any other computer-based method of predicting peptide-MHC Class II interactions that yields numerical scores for each peptide/MHC Class II pair, is calibrated against a data set comprising a large number of peptides whose affinity for various MHC Class II molecules has previously been experimentally determined. By comparison of calculated versus experimental data, a cut of value can be determined above which it is known that all experimentally determined T-cell epitopes are correctly predicted.

Specifically, the computer-derived numerical score is calculated for each peptide/MHC Class II pair in the data set. The score is calculated such that a higher score represents an increased probability of binding. The lowest computer-based score for a peptide/MHC Class II pair that is found experimentally to bind is taken to be a cutoff. All computer-based scores that are significantly below this cutoff score are considered to represent non-binding peptide/MHC Class II pairs, while computer-based scores above the cutoff represent a potential binding peptide/MHC Class II pair. In general for a given computer-based scoring algorithm, there will be some peptide/MHC Class II combinations that give scores above the cutoff but that do not actually bind. Thus, this preferred embodiment of the method may generate false-positives, but will never or only rarely generate false negatives.

This cutoff-based embodiment of the method is particularly useful when a goal is to eliminate, by mutation, most or all of the T-cell epitopes from a protein. Specifically, according to a more preferred embodiment of the method of the invention, most or all of the T-cell epitopes are removed from a protein as follows. The protein sequence is scanned by a computer-based algorithm for potential T-cell epitopes. Each potential T-cell epitope is given a score, with increasing scores correlated with higher probability of binding to an MHC Class II. Each peptide segment with a score greater than a cutoff is mutated such that the score of the mutated segment is less than the cutoff. Mutations are preferentially chosen that do not reduce the activity of the protein below an activity necessary for a given purpose. A multiply mutated protein, lacking most or all of its computer-predicted T-cell epitopes, is designed. Such a multiply mutated protein is termed a "DeImmunized protein".

The DeImmunized protein is synthesized by standard methods. For example, an artificial DNA sequence encoding the DeImmunized protein is assembled from synthetic oligonucleotides, ligated into an expression vector and functionally linked to elements promoting expression of the DeImmunized protein. The DeImmunized protein is then purified by standard methods. The resulting DeImmunized protein contains mutated amino acids such that genuine T-cell epitopes are eliminated. In addition, the DeImmunized protein will often contain mutated amino acids in segments that are predicted by an algorithm to be T-cell epitopes, but that are not in fact T-cell epitopes. However, significant deleterious consequences do not result from the mutations in the falsely predicted epitopes, because the mutations are chosen to have little effect on protein activity. Moreover, deleterious consequences do not result from the possible introduction of new B cell epitopes into a protein, because the lack of T-cell epitopes prevents a B cell response to the modified protein.

Application of the above-described methodology to various peptides which may be considered for DeImmunization, for modifications to enhance MHC Class II binding for therapeutic purposes, is exemplified below.

The invention may be applied to any biological molecule having a defined biological and/or pharmocological activity with substantially the same primary amino acid sequences as those disclosed herein and would include therefore molecules derived by genetic engineering means or other processes. The term "biological molecule" is used herein for molecules which have a biological function and cause a biological, pharmacological or pharmaceutical effect or activity. Preferably, biological molecules according to the inventions are peptides, polypeptides, proteins. Hereunder proteins, immunoglobulins are preferred. The invention includes also variants and other modification of a specific polypeptide, protein, fusion protein, immunoglobulin which have in principal the same biological activity and a similar (reduced) immunogenicity. Furthermore fragments of antibodies like sFv, Fab, Fab', F(ab')2 and Fc and biologically effective fragments of proteins are included. Antibodies from human origin or humanized antibodies show per se lower or no immunogenicity in humans and have no or a lower number of immunogenic epitopes compared to non-human antibodies. Nevertheless there is also a need for de-immunization of such molecules since some of them have been shown to elicit a significant immune response in humans. Furthermore antigens which elicit a not desired and too strong immune response can be modified according to the method of the invention and result in antigens which have a reduced immunogenicity which is however strong enough for using the antigen e.g. as vaccine.

Some molecules, like leptin, such as identified from other mammalian sources have in common many of the peptide sequences of the present disclosure and have in common many peptide sequences with substantially the same sequence as those of the disclosed listing. Such protein sequences equally therefore fall under the scope of the present invention.

The invention relates to analogues of the biological molecules according to the invention in which substitutions of at least one amino acid residue have been made at positions resulting in a substantial reduction in activity of or elimination of one or more potential T-cell epitopes from the protein.

One or more amino acid substitutions at particular points within any of the potential MHC class II ligands identified in the tables of the examples may result in a molecule with a reduced immunogenic potential when administered as a therapeutic to the human host. Preferably, amino acid substitutions are made at appropriate points within the peptide sequence predicted to achieve substantial reduction or elimination of the activity of the T-cell epitope. In practice an appropriate point will preferably equate to an amino acid residue binding within one of the hydrophobic pockets provided within the MHC class II binding groove. Amino acid residues in the peptide at positions equating to binding within other pocket regions within the MHC binding cleft are also considered and fall under the scope of the present.

It is understood that single amino acid substitutions within a given potential T-cell epitope are the most preferred route by which the epitope may be eliminated. Combinations of substitution within a single epitope may be contemplated and for example can be particularly appropriate where individually defined epitopes are in overlap with each other. Moreover, amino acid substitutions either singly within a given epitope or in combination within a single epitope may be made at positions not equating to the "pocket residues" with respect to the MHC class II binding groove, but at any point within the peptide sequence. All such substitutions fall within the scope of the present.

Amino acid substitutions other than within the peptides identified above may be contemplated particularly when made in combination with substitution(s) made within a listed peptide. For example a change may be contemplated to restore structure or biological activity of the variant molecule. Such compensatory changes and changes to include deletion or addition of particular amino acid residues from the molecule according to the invention resulting in a variant with desired activity and in combination with changes in any of the disclosed peptides fall under the scope of the present.

In another aspect, the present invention relates to nucleic acids encoding said biological molecules having reduced immunogenicity. Methods for making gene constructs and gene products are well known in the art. In a final aspect the present invention relates to pharmaceutical compositions comprising said biological molecules obtainable by the methods disclosed in the present invention, and methods for therapeutic treatment of humans using the modified molecules and pharmaceutical compositions.

As can be seen from the following examples, the computational methods described herein above provide a very good indicator of where T-cell epitopes are likely to be found in any peptide. This, therefore, allows identification of regions of amino acid residue sequences which, if altered by one or more amino acid residue changes, have the effect of removing T-cell epitopes and thus enhance the therapeutic value of the peptide. By means of this method biological molecules like peptides, proteins, immunoglobulins and fusion proteins and the like having enhanced properties and pharmacological value can be prepared.

The foregoing description and the examples are intended as illustrative, and are not to be taken as limiting. Still other variants within the spirit and scope of this invention are possible and will readily present themselves to those skilled in the art.

EXAMPLE 1

This example shows the T-cell epitope likelihood profile of the autoantigen glutamic acid decarboxylase isoform (GAD 65; MW: 65.000), which is involved in the development of Type I diabetes. This particular protein could be a potential target for increasing the affinity of T-cell epitopes, and also provides a good example for demonstrating the T-cell epitope likelihood index since it is a relatively long peptide (585 amino acid residues) and, therefore, provides a relatively large sample size for profiling.

Figure 4:
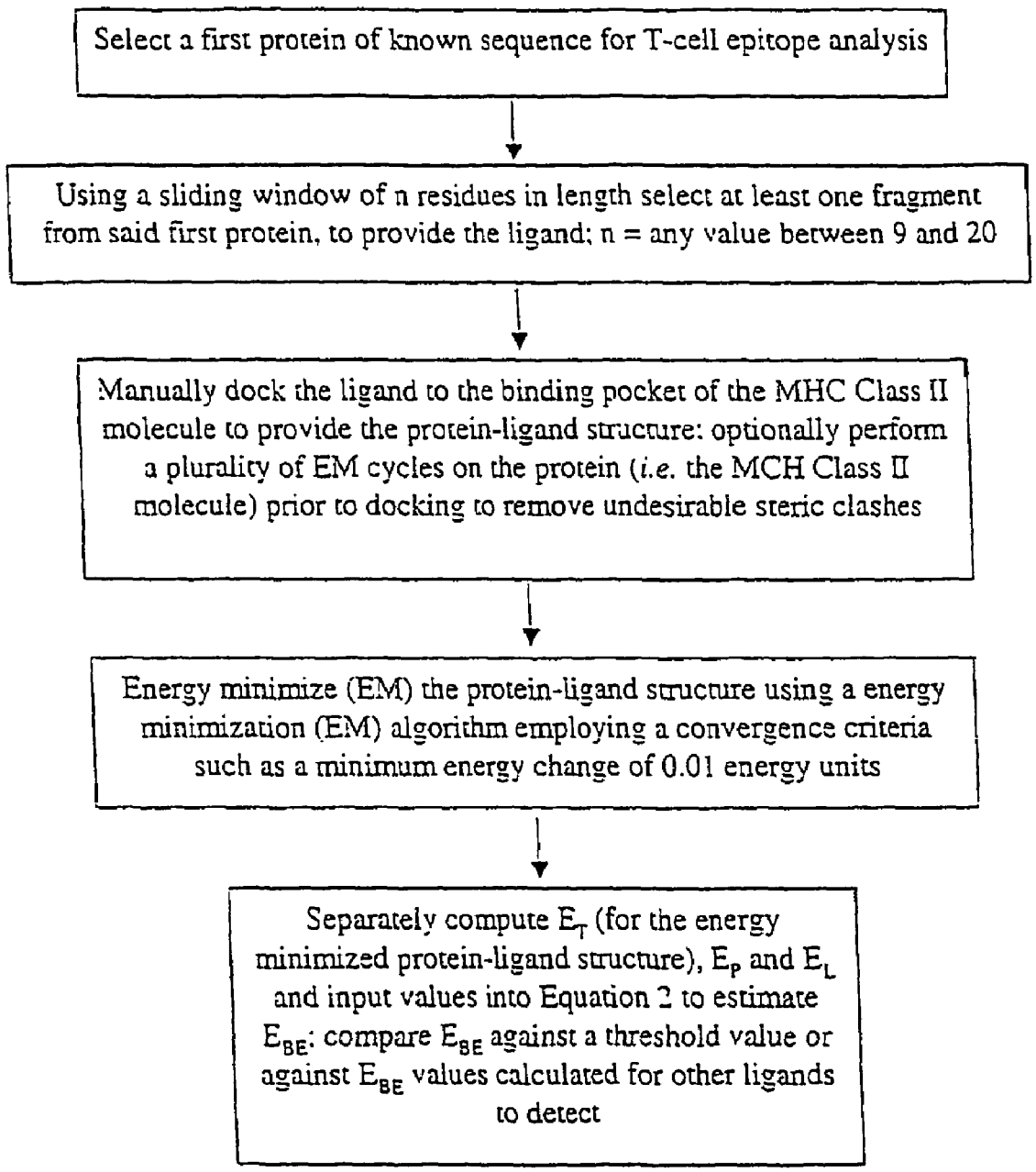
FIG. 4 is a further flow chart illustrating the computational method.
Figure 5:
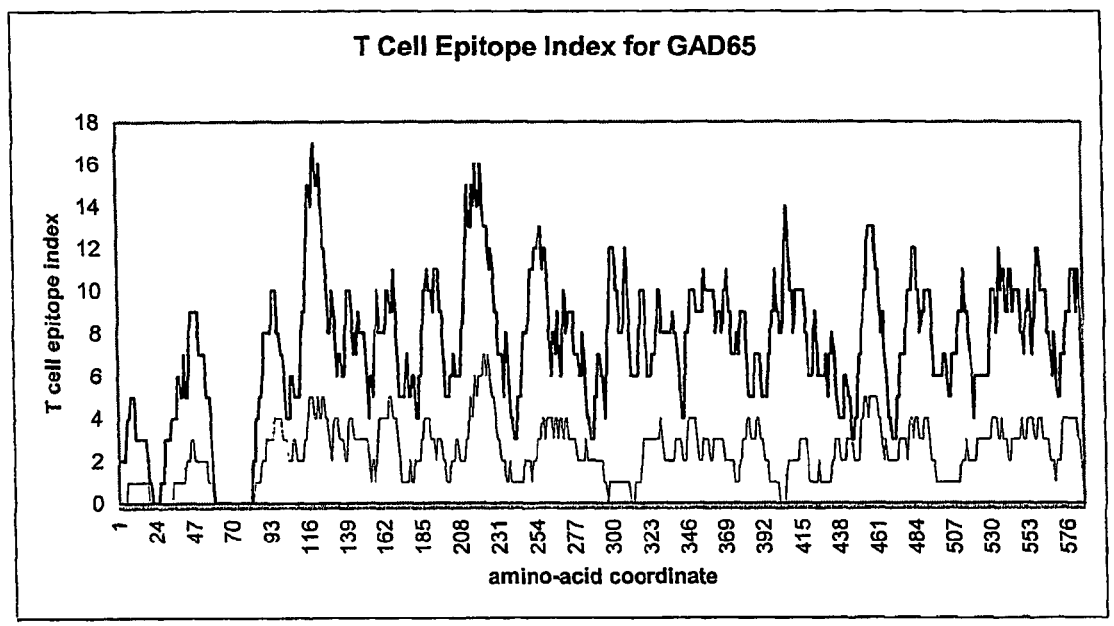
FIG. 5 is a plot of T-cell epitope likelihood index versus amino acid residue coordinates (positions) of glutamic acid decarboxylase (MW: 65000) isoform (GAD 65)

Shown in FIG. 5 is the T-cell epitope likelihood profile for GAD 65. The solid line represents the T-cell epitope index calculated using the computational method shown in FIG. 1, and the dotted line represents the T-cell epitope index predicted using the computational method shown in FIGS. 3 and 4.

EXAMPLE 2

This example shows the T-cell epitope likelihood profile of erythropoietin (EPO), a 193 amino acid residue long cytokine widely used as an intravenously (IV) administered drug to boost red blood cell counts. This represents a good example of a biologic drug with therapeutic value but which could induce inappropriate or undesirable immune responses, especially with the IV route of administration being used, and which may, therefore, benefit from de-immunization after Potential T-cell epitopes therein have been identified.

Figure 6:
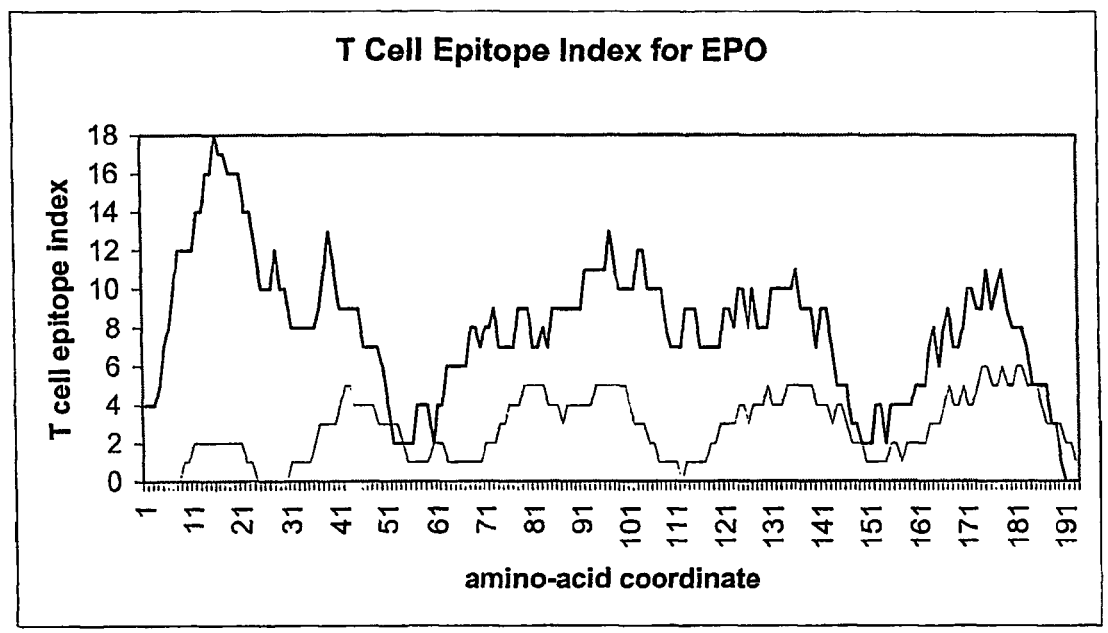
FIG. 6 is a plot of T-cell epitope likelihood index versus amino acid residue coordinates (positions) for erythropoietin (EPO)

Shown in FIG. 6 is the T-cell epitope likelihood profile for EPO. The solid line represents the T-cell epitope index calculated using the computational method shown in FIG. 1, and the dotted line indicates T-cell epitope index predicted using the computational method shown in FIGS. 3 and 4.

EXAMPLE 3

Figure 7:
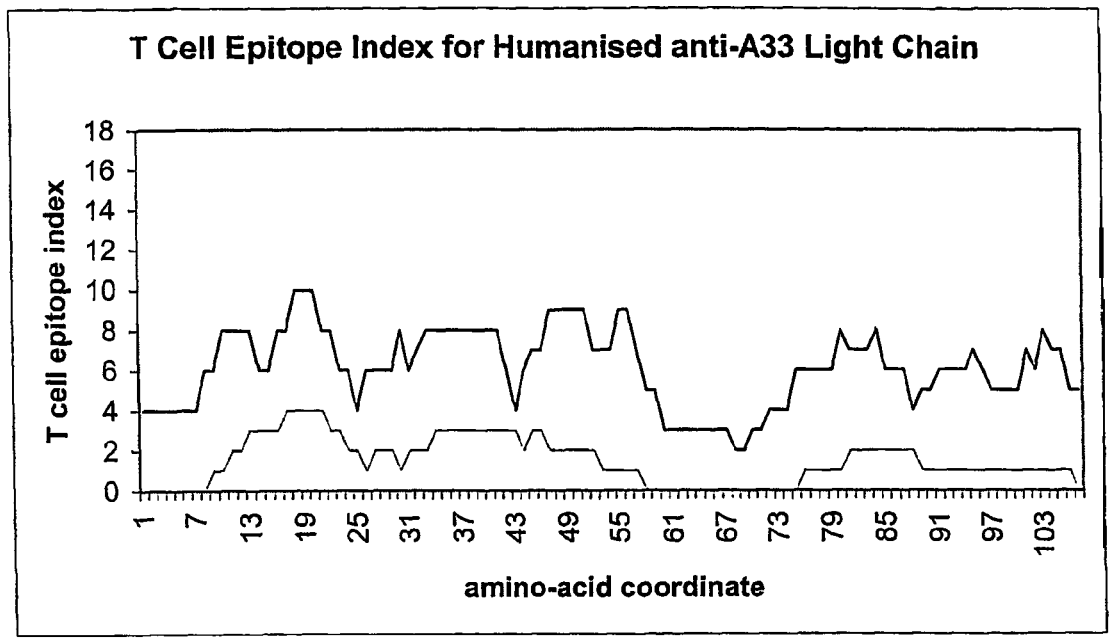
FIG. 7 is a plot of T-cell epitope likelihood index versus amino acid residue coordinates (positions) for humanized anti-A33 monoclonal antibody light chain.
Figure 8:
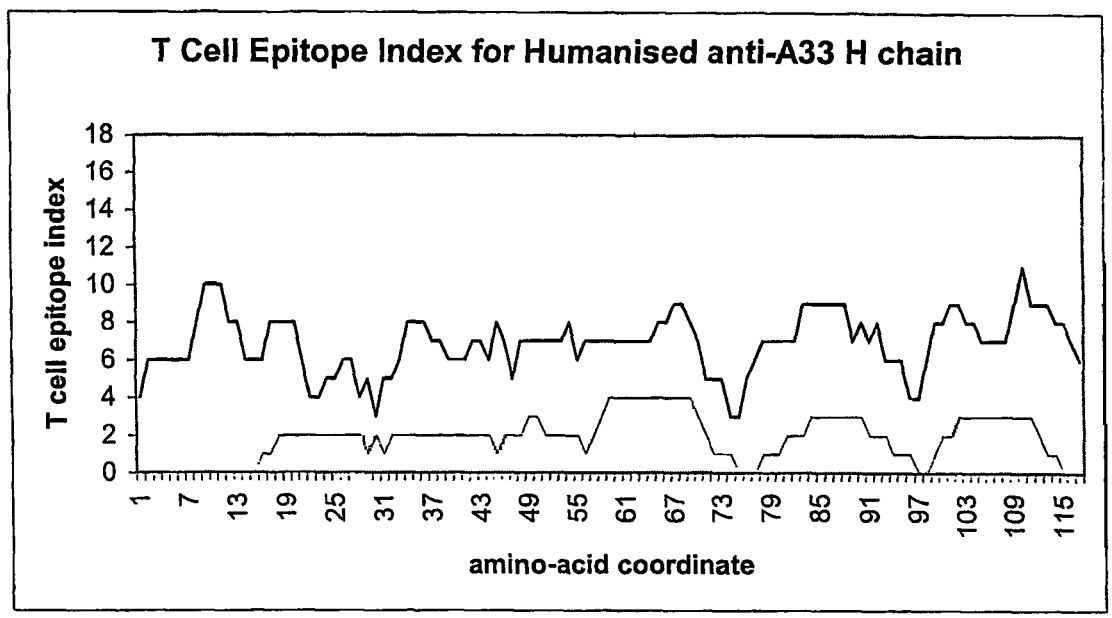
FIG. 8 is a plot of T-cell epitope likelihood index versus amino acid residue coordinates (positions) for humanized anti-A33 monoclonal antibody heavy chain. In the foregoing FIGS. 5-8, the solid line ( - - - ) depicts a T-cell epitope index calculated by a computational method in accordance with the flow chart shown in FIG. 1, and the dotted line ( . . . ) depicts the predicted number of T-cell epitopes calculated in accordance with the computational method in accordance with the flow chart shown in FIG. 3 according to another aspect of the present invention.

FIGS. 7 and 8 show the T-cell epitope index for the heavy and light chains of a mouse humanized monoclonal antibody directed against A33 antigen. The latter is a transmembrane glycoprotein expressed on the surface of >95% bowel cancers and, therefore, has potential as an anti-cancer therapeutic.

Figure 3:
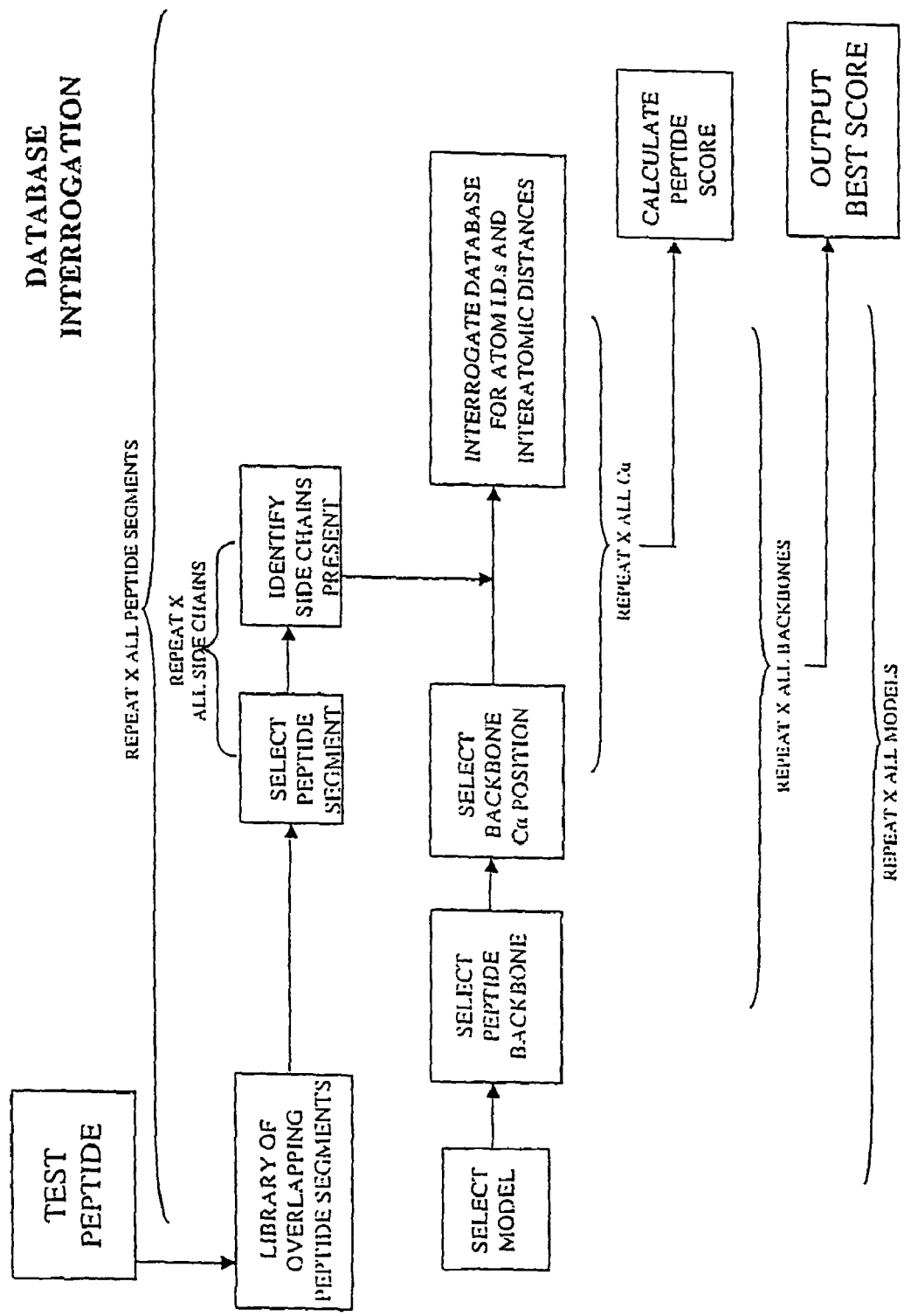
FIG. 3 is a flow chart illustrating database interrogation for profiling a peptide for potential T-cell epitopes.

In FIGS. 7 and 8, the solid line represents the T-cell epitope index calculated using the computational method shown in FIG. 1, and the dotted line represents the T-cell epitope index predicted using the computational method shown in FIGS. 3 and 4.

EXAMPLE 4

(Leptin)

One of these therapeutically valuable molecules is human obesity protein, called "leptin". Leptin is a secreted signaling protein of 146 amino acid residues involved in the homeostatic mechanisms maintaining adipose mass (e.g. WO 00/40615, WO 98/28427, WO 96/05309). The protein (and its antagonists) offers significant therapeutic potential for the treatment of diabetes, high blood pressure and cholesterol metabolism. The protein can be produced by recombinant technologies using a number of different host T-cell types. The amino acid sequence of leptin (depicted as one-letter code) is as follows:

```
VPIQKVQDDTKTLIKTIVTRINDISHTQSVSSKQKVTGLDFIPGLHPILTLSKMDQTLAVYQQILTSM
PSRNVIQISNDLENLRDLLHVLAFSKSCHLPWASGLETLDSLGGVLEASGYSTEVVALSRLQGSLQDM
LWQLDLSPGC.
(SEQ. ID NO: 1)
```

An amino acid sequence which is part of the sequence of an immunogenically non-modified human obesity protein (leptin) and has a potential MHC class II binding activity is selected from the following group in Table 1 identified according to the method of the invention.

TABLE 1

| | | | |
|---|---|---|---|
| VPIQKVQDDTKTL, (SEQ ID NO: 2) | QKVQDDTKTLIKT, (SEQ ID NO: 3) | KTLIKTIVTRIND, (SEQ ID NO: 4) | TLIKTIVTRINDI, (SEQ ID NO: 5) |
| KTIVTRINDISHT, (SEQ ID NO: 6) | TIVTRINDISHTQ, (SEQ ID NO: 7) | TRINDISHTQSVS, (SEQ ID NO: 8) | NDISHTQSVSSKQ, (SEQ ID NO: 9) |
| QSVSSKQKVTGLD, (SEQ ID NO: 10) | SSKQKVTGLDFIP, (SEQ ID NO: 11) | QKVTGLDFIPGLH, (SEQ ID NO: 12) | TGLDFIPGLHPIL, (SEQ ID NO: 13) |
| LDFIPGLHPILTL, (SEQ ID NO: 14) | DFIPGLHPILTLS, (SEQ ID NO: 15) | PGLHPILTLSKMD, (SEQ ID NO: 16) | GLHPILTLSKMDQ, (SEQ ID NO: 17) |
| HPILTLSKMDQTL, (SEQ ID NO: 18) | PILTLSKMDQTLA, (SEQ ID NO: 19) | LTLSKMDQTLAVY, (SEQ ID NO: 20) | SKMDQTLAVYQQI, (SEQ ID NO: 21) |
| QTLAVYQQILTSM, (SEQ ID NO: 22) | LAVYQQILTSMPS, (SEQ ID NO: 23) | AVYQQILTSMPSR, (SEQ ID NO: 24) | QQILTSMPSRNVI, (SEQ ID NO: 25) |
| QILTSMPSRNVIQ, (SEQ ID NO: 26) | TSMPSRNVIQISN, (SEQ ID NO: 27) | SRNVIQISNDLEN, (SEQ ID NO: 28) | RNVIQISNDLENL, (SEQ ID NO: 29) |
| NVIQISNDLENLR, (SEQ ID NO: 30) | IQISNDLENLRDL, (SEQ ID NO: 31) | NDLENLRDLLHVL, (SEQ ID NO: 32) | LENLRDLLHVLAF, (SEQ ID NO: 33) |
| ENLRDLLHVLAFS, (SEQ ID NO: 34) | RDLLHVLAFSKSC, (SEQ ID NO: 35) | DLLHVLAFSKSCH, (SEQ ID NO: 36) | LHVLAFSKSCHLP, (SEQ ID NO: 37) |
| HVLAFSKSCHLPW, (SEQ ID NO: 38) | LAFSKSCHLPWAS, (SEQ ID NO: 39) | CHLPWASGLETLD, (SEQ ID NO: 40) | SGLETLDSLGGVL, (SEQ ID NO: 41) |
| DSLGGVLEASGYS, (SEQ ID NO: 42) | SLGGVLEASGYST, (SEQ ID NO: 43) | GGVLEASGYSTEV, (SEQ ID NO: 44) | SGYSTEVVALSRL. (SEQ ID NO: 45) |

Any of the above-cited peptide sequences can be used for modifying by exchanging one or more amino acids to obtain a sequence having a reduced or no immunogenicity.

Substitutions carried out according to the methods of the invention leading to the elimination of potential T-cell epitopes of human leptin (WT=wild type) are shown in Table 2.

TABLE 2

| Residue # | WT residue | Substitutions |
|---|---|---|
| 3 | I | A C D E G H K N P Q R S T |
| 6 | V | A C D E G H K N P Q R S T |
| 13 | L | A C D E G H K N P Q R S T |
| 14 | I | A C D E G H K N P Q R S T |
| 17 | I | A C D E G H K N P Q R S T |
| 18 | V | A C D E G H K N P Q R S T |
| 21 | I | A C D E G H K N P Q R S T |
| 24 | I | A C D E G H K N P Q R S T |
| 30 | V | A C D E G H K N P Q R S T |
| 36 | V | A C D E G H K N P Q R S T |
| 39 | L | A C D E G H K N P Q R S T |
| 41 | F | A C D E G H K N P Q R S T |
| 42 | I | A C D E G H K N P Q R S T |
| 45 | L | A C D E G H K N P Q R S T |
| 48 | I | A C D E G H K N P Q R S T |
| 49 | L | A C D E G H K N P Q R S T |
| 51 | L | A C D E G H K N P Q R S T |
| 54 | M | A C D E G H K N P Q R S T |
| 58 | L | A C D E G H K N P Q R S T |
| 60 | V | A C D E G H K N P Q R S T |
| 61 | Y | A C D E G H K N P Q R S T |
| 64 | I | A C D E G H K N P Q R S T |
| 65 | L | A C D E G H K N P Q R S T |
| 68 | M | A C D E G H K N P Q R S T |
| 73 | V | A C D E G H K N P Q R S T |
| 74 | I | A C D E G H K N P Q R S T |
| 76 | I | A C D E G H K N P Q R S T |
| 80 | L | A C D E G H K N P Q R S T |
| 83 | L | A C D E G H K N P Q R S T |
| 86 | L | A C D E G H K N P Q R S T |
| 87 | L | A C D E G H K N P Q R S T |
| 89 | V | A C D E G H K N P Q R S T |
| 90 | L | A C D E G H K N P Q R S T |

TABLE 2-continued

| Residue # | WT residue | Substitutions |
|---|---|---|
| 92 | F | A C D E G H K N P Q R S T |
| 98 | L | A C D E G H K N P Q R S T |
| 100 | W | A C D E G H K N P Q R S T |
| 104 | L | A C D E G H K N P Q R S T |
| 107 | L | A C D E G H K N P Q R S T |
| 110 | L | A C D E G H K N P Q R S T |
| 113 | V | A C D E G H K N P Q R S T |
| 114 | L | A C D E G H K N P Q R S T |
| 119 | Y | A C D E G H K N P Q R S T |
| 123 | V | A C D E G H K N P Q R S T |
| 124 | V | A C D E G H K N P Q R S T |
| 126 | L | A C D E G H K N P Q R S T |
| 129 | L | A C D E G H K N P Q R S T |
| 133 | L | A C D E G H K N P Q R S T |
| 136 | M | A C D E G H K N P Q R S T |

EXAMPLE 5

(IL-1R Antagonist)

IL-1 is an important inflammatory and immune modulating cytokine with pleiotropic effects on a variety of tissues but may contribute to the pathology associated with rheumatoid arthritis and other diseases associated with local tissue damage. An IL-1 receptor antagonist able to inhibit the action of IL-1 has been purified and the gene cloned [Eisenburg S. P. et al (1990) Nature, 343:341-346, Carter, D. B., et al. (1990) Nature, 344: 633-637]. Others have provided IL-1Ra molecules [e.g. U.S. Pat. No. 5,075,222].

The amino acid sequence of Il-1Ra (depicted as one-letter code) is as follows:

RPSGRKSSKMQAFRIWDVNQKTFYLRNNQLVAGYLQGPNVNLEEKIDVVPIEPHALFLGIHGGKMCLSC

VKSGDETRLQLEAVNITDLSENRKQDKRFAFIRSDSGPTTSFESAACPGWFLCTAMEADQPVSLTNMPD

EGVMVTKFYFQEDE.
(SEQ ID NO: 46)

An amino acid sequence which is part of the sequence of an immunogenically non-modified IL-1Ra, which has a potential MHC class II binding activity is selected from the following group shown in Table 3.

TABLE 3

| | | |
|---|---|---|
| RKSSKMQAFRIWD, (SEQ ID NO: 47) | SKMQAFRIWDVNQ, (SEQ ID NO: 48) | QAFRIWDVNQKTF, (SEQ ID NO: 49) |
| FRIWDVNQKTFYL, (SEQ ID NO: 50) | RIWDVNQKTFYLR, (SEQ ID NO: 51) | IWDVNQKTFYLRN, (SEQ ID NO: 52) |

TABLE 3-continued

| | | |
|---|---|---|
| WDVNQKTFYLRNN, (SEQ ID NO: 53) | KTFYLRNNQLVAG, (SEQ ID NO: 54) | TFYLRNNQLVAGY, (SEQ ID NO: 55) |
| FYLRNNQLVAGYL, (SEQ ID NO: 56) | LRNNQLVAGYLQG, (SEQ ID NO: 57) | RNNQLVAGYLQGP, (SEQ ID NO: 58) |
| NQLVAGYLQGPNV, (SEQ ID NO: 59) | QLVAGYLQGPNVN, (SEQ ID NO: 60) | LVAGYLQGPNVNL, (SEQ ID NO: 61) |
| AGYLQGPNVNLEE, (SEQ ID NO: 62) | GYLQGPNVNLEEK, (SEQ ID NO: 63) | PNVNLEEKIDVVP, (SEQ ID NO: 64) |
| VNLEEKIDVVPIE, (SEQ ID NO: 65) | EKIDVVPIEPHAL, (SEQ ID NO: 66) | IDVVPIEPHALFL, (SEQ ID NO: 67) |
| DVVPIEPHALFLG, (SEQ ID NO: 68) | VPIEPHALFLGIH, (SEQ ID NO: 69) | HALFLGIHGGKMC, (SEQ ID NO: 70) |
| ALFLGIHGGKMCL, (SEQ ID NO: 71) | LFLGIHGGKMCLS, (SEQ ID NO: 72) | LGIHGGKMCLSCV, (SEQ ID NO: 73) |
| GKMCLSCVKSGDE, (SEQ ID NO: 74) | MCLSCVKSGDETR, (SEQ ID NO: 75) | SCVKSGDETRLQL, (SEQ ID NO: 76) |
| ETRLQLEAVNITD, (SEQ ID NO: 77) | TRLQLEAVNITDL, (SEQ ID NO: 78) | LQLEAVNITDLSE, (SEQ ID NO: 79) |
| EAVNITDLSENRK, (SEQ ID NO: 80) | VNITDLSENRKQD, (SEQ ID NO: 81) | TDLSENRKQDKRF, (SEQ ID NO: 82) |
| ENRKQDKRFAFIR, (SEQ ID NO: 83) | KRFAFIRSDSGPT, (SEQ ID NO: 84) | FAFIRSDSGPTTS, (SEQ ID NO: 85) |
| AFIRSDSGPTTSF, (SEQ ID NO: 86) | TSFESAACPGWFL, (SEQ ID NO: 87) | SFESAACPGWFLC, (SEQ ID NO: 88) |
| PGWFLCTAMEADQ, (SEQ ID NO: 89) | WFLCTAMEADQPV, (SEQ ID NO: 90) | TAMEADQPVSLTN, (SEQ ID NO: 91) |
| QPVSLTNMPDEGV, (SEQ ID NO: 92) | VSLTNMPDEGVMV, (SEQ ID NO: 93) | TNMPDEGVMVTKF, (SEQ ID NO: 94) |
| PDEGVMVTKFYFQ, (SEQ ID NO: 95) | EGVMVTKFYFQED, (SEQ ID NO: 96) | GVMVTKFYFQEDE. (SEQ ID NO: 97) |

Any of the above-cited peptide sequences can be used for modifying by exchanging one or more ammo acids to obtain a sequence having a reduced or no immunogenicity.

Substitutions leading to the elimination of potential T-cell epitopes are shown in Table 4.

TABLE 4

| Residue # | WT Residue | Substitution |
|---|---|---|
| 10 | M | A C D E Q H K N P Q R S T |
| 13 | F | A C D E G H K N P Q R S T |
| 15 | I | A C D E G H K N P Q R S T |
| 16 | W | A C D E G H K N P Q R S T |

TABLE 4-continued

| Residue # | WT Residue | Substitution |
|---|---|---|
| 18 | V | A C D E G H K N P Q R S T |
| 23 | F | A C D E G H K N P Q R S T |
| 24 | Y | A C D E G H K N P Q R S T |
| 25 | L | A C D E G H K N P Q R S T |
| 30 | L | A C D E G H K N P Q R S T |
| 31 | V | A C D E G H K N P Q R S T |
| 34 | Y | A C D E G H K N P Q R S T |
| 35 | L | A C D E Q H K N P Q R S T |
| 40 | V | A C D E G H K N P Q R S T |
| 42 | L | A C D E G H K N P Q R S T |
| 46 | I | A C D E G H K N P Q R S T |
| 48 | V | A C D E G H K N P Q R S T |
| 49 | V | A C D E G H K N P Q R S T |
| 51 | I | A C D E G H K N P Q R S T |
| 56 | L | A C D E G H K N P Q R S T |
| 57 | F | A C D E G H K N P Q R S T |
| 58 | L | A C D E G H K N P Q R S T |
| 60 | I | A C D E G H K N P Q R S T |
| 65 | M | A C D E G H K N P Q R S T |
| 67 | L | A C D E G H K N P Q R S T |
| 70 | V | A C D E G H K N P Q R S T |
| 78 | L | A C D E G H K N P Q R S T |
| 80 | L | A C D E G H K N P Q R S T |
| 83 | V | A C D E G H K N P Q R S T |
| 85 | I | A C D E G H K N P Q R S T |
| 88 | L | A C D E G H K N P Q R S T |
| 98 | F | A C D E G H K N P Q R S T |
| 100 | F | A C D E G H K N P Q R S T |
| 101 | I | A C D E G H K N P Q R S T |
| 119 | W | A C D E G H K N P Q R S T |
| 120 | F | A C D E G H K N P Q R S T |
| 121 | L | A C D E G H K N P Q R S T |
| 125 | M | A C D E G H K N P Q R S T |
| 131 | V | A C D E G H K N P Q R S T |
| 133 | L | A C D E G H K N P Q R S T |
| 136 | M | A C D E G H K N P Q R S T |
| 141 | V | A C D E G H K N P Q R S T |
| 142 | M | A C D E G H K N P Q R S T |

EXAMPLE 6

(BDNF)

Another therapeutically valuable molecule is "human brain-derived neurotrophic factor BDNF)". BDNF is glycoprotein of the nerve growth factor family of proteins. The mature 119 amino acid glycoprotein is processed from a larger pre-cursor to yield a neurotrophic factor that promotes the survival of neuronal cell populations [Jones K. R. & Reichardt, L. F. (1990) *Proc. Natl. Acad. Sci. U.S.A.* 87: 8060-8064]. Such neuronal cells are all located either in the central nervous system or directly connected to it. Recombinant preparations of BDNF have enabled the therapeutic potential of the protein to be explored for the promotion of nerve regeneration and degenerative disease therapy.

The amino acid sequence of human brain-derived neurotrophic factor BDNF (depicted as one-letter code) is as follows:

HSDPARRGELSVCDSISEWVTAADKKTAVDMSGGTVTVLEKVPVSKGQLKQYFYETKCNPMGYTKEGCR
GIDKRHWNSQCRTTQSYVRALTMDSKKRIGWFIRIDTSCVCTLTIKRGR.
(SEQ ID NO: 98)

Others have provided modified BDNF molecules [U.S. Pat. No. 5,770,577] and approaches towards the commercial production of recombinant BDNF molecules [U.S. Pat. No. 5,986,070].

An amino acid sequence which is part of the sequence of an immunogenically non-modified human brain derived neurotrophic factor (BDNF) and has a potential MHC class II binding activity is selected from the following group shown in Table 5.

TABLE 5

| | | | |
|---|---|---|---|
| GELSVCDSISEWV, (SEQ ID NO: 99) | LSVCDSISEWVTA, (SEQ ID NO: 100) | DSISEWVTAADKK, (SEQ ID NO: 101) | SEWVTAADKKTAV, (SEQ ID NO: 102) |
| EWVTAADKKTAVD, (SEQ ID NO: 103) | WVTAADKKTAVDM, (SEQ ID NO: 104) | KTAVDMSGGTVTV, (SEQ ID NO: 105) | TAVDMSGGTVTVL, (SEQ ID NO: 106) |
| VDMSGGTVTVLEK, (SEQ ID NO: 107) | GTVTVLEKVPVSK, (SEQ ID NO: 108) | VTVLEKVPVSKGQ, (SEQ ID NO: 109) | TVLEKVPVSKGQL, (SEQ ID NO: 110) |
| EKVPVSKGQLKQY, (SEQ ID NO: 111) | VPVSKGQLKQYFY, (SEQ ID NO: 112) | GQLKQYFYETKCN, (SEQ ID NO: 113) | KQYFYETKCNPMG, (SEQ ID NO: 114) |
| QYFYETKCNPMGY, (SEQ ID NO: 115) | YFYETKCNPMGYT, (SEQ ID NO: 116) | NPMGYTKEGCRGI, (SEQ ID NO: 117) | MGYTKEGCRGIDK, (SEQ ID NO: 118) |
| RGIDKRHWNSQCR, (SEQ ID NO: 119) | RHWNSQCRTTQSY, (SEQ ID NO: 120) | HWNSQCRTTQSYV, (SEQ ID NO: 121) | QSYVRALTMDSKK, (SEQ ID NO: 122) |
| SYVRALTMDSKKR, (SEQ ID NO: 123) | RALTMDSKKRIGW, (SEQ ID NO: 124) | LTMDSKKRIGWRF, (SEQ ID NO: 125) | KRIGWRFIRIDTS, (SEQ ID NO: 126) |
| IGWRFIRIDTSCV, (SEQ ID NO: 127) | GWRFIRIDTSCVC, (SEQ ID NO: 128) | WRFIFIDTSCVCT, (SEQ ID NO: 129) | RFIRIDTSCVCTL, (SEQ ID NO: 130) |
| IRIDTSCVCTLTI, (SEQ ID NO: 131) | IDTSCVCTLTIKR. (SEQ ID NO: 132) | | |

Any of the above-cited peptide sequences can be used for modifying by exchanging one or more amino acids to obtain a sequence having a reduced or no immunogenicity.

Substitutions leading to the elimination of potential T-cell epitopes of human brain-derived neurotrophic factor (BDNF) (WT=wild type) are shown in Table 6.

TABLE 6

| Residue # | WT Residue | Substitution |
|---|---|---|
| 10 | L | A C D E G H K N P Q R S T |
| 16 | I | A C D E G H K N P Q R S T |
| 20 | V | A C D E G H K N P Q R S T |
| 29 | V | A C D E G H K N P Q R S T |
| 31 | M | A C D E G H K N P Q R S T |
| 36 | V | A C D E G H K N P Q R S T |
| 38 | V | A C D E G H K N P Q R S T |
| 39 | L | A C D E G H K N P Q R S T |
| 42 | V | A C D E G H K N P Q R S T |
| 44 | V | A C D E G H K N P Q R S T |
| 49 | L | A C D E G H K N P Q R S T |
| 52 | Y | A C D E G H K N P Q R S T |
| 53 | F | A C D E G H K N P Q R S T |
| 54 | Y | A C D E G H K N P Q R S T |
| 61 | M | A C D E G H K N P Q R S T |
| 63 | Y | A C D E G H K N P Q R S T |
| 71 | I | A C D E G H K N P Q R S T |
| 76 | W | A C D E G H K N P Q R S T |
| 86 | Y | A C D E G H K N P Q R S T |
| 87 | V | A C D E G H K N P Q R S T |
| 90 | L | A C D E G H K N P Q R S T |
| 92 | M | A C D E G H K N P Q R S T |
| 98 | I | A C D E G H K N P Q R S T |
| 100 | W | A C D E G H K N P Q R S T |
| 102 | F | A C D E G H K N P Q R S T |
| 103 | I | A C D E G H K N P Q R S T |
| 105 | I | A C D E G H K N P Q R S T |

EXAMPLE 7

(EPO)

Another therapeutically valuable molecule is erythropoietin (EPO). EPO is a glycoprotein hormone involved in the maturation of erythroid progenitor cells into erythrocytes. Naturally occurring EPO is produced by the liver during foetal life and by the kidney of adults and circulates in the blood to stimulate production of red blood cells in bone marrow. Anaemia is almost invariably a consequence of renal failure due to decreased production of EPO from the kidney. Recombinant EPO is used as an effective treatment of anaemia resulting from chronic renal failure. Recombinant EPO (expressed in mammalian cells) having the amino acid sequence 1-165 of human erythropoietin [Jacobs, K. et al (1985) *Nature,* 313:806-810; Lin, F.-K. et al (1985) *Proc. Natl. Acad. Sci. U.S.A.* 82: 7580-7585] contains three N-linked and one O-linked oligosaccharide chains each containing terminal sialic acid residues. The latter are significant in enabling EPO to evade rapid clearance from the circulation by the hepatic asialoglycoprotein binding protein.

The amino acid sequence of EPO (depicted as one-letter code) is as follows:

```
APPRLICDSRVLERYLLEAKEAENITTGCAEHCSLNENITVPDTKVNFYAWKRMEVGQQAVEVWQGLAL
LSEAVLRGQALLVNSSQPWEPLQLHVDKAVSGLRSLTTLLRALGAQKEAISPPDAASAAPLRTITADTF
RKLFRVYSNFLRGKLKLYTGEACRTGDR.
(SEQ ID NO: 133)
```

An amino acid sequence which is part of the sequence of an immunogenically non-modified human erythropoietin (EPO) and has a potential MHC class II binding activity is selected from the following group shown in Table 7.

TABLE 7

| | | | | |
|---|---|---|---|---|
| PRLICDSRVLERY, (SEQ ID NO: 134) | RLICDSRVLERYL, (SEQ ID NO: 135) | ICDSRVLERYLLE, (SEQ ID NO: 136) | CDSRVLERYLLEA, (SEQ ID NO: 137) | SRVLERYLLEAKE, (SEQ ID NO: 138) |
| RVLERYLLEAKEA, (SEQ ID NO: 139) | LERYLLEAKEAEN, (SEQ ID NO: 140) | ERYLLEAKEAENI, (SEQ ID NO: 141) | RYLLEAKEAENIT, (SEQ ID NO: 142) | YLLEAKEAENITT, (SEQ ID NO: 143) |
| LEAKEAENITTGC, (SEQ ID NO: 144) | KEAENITTGCAEH, (SEQ ID NO: 145) | ENITTGCAEHCSL, (SEQ ID NO: 146) | CSLNENITVPDTK, (SEQ ID NO: 147) | NENITVPDTKVNF, (SEQ ID NO: 148) |
| ENITVPDTKVNFY, (SEQ ID NO: 149) | NITVPDTKVNFYA, (SEQ ID NO: 150) | ITVPDTKVNFYAW, (SEQ ID NO: 151) | TKVNFYAWKRMEV, (SEQ ID NO: 152) | VNFYAWKRMEVGQ, (SEQ ID NO: 153) |
| NFYAWKRMEVGQQ, (SEQ ID NO: 154) | YAWKRMEVGQQAV, (SEQ ID NO: 155) | KRMEVGQQAVEVW, (SEQ ID NO: 156) | RMEVGQQAVEVWQ, (SEQ ID NO: 157) | MEVGQQAVEVWQG, (SEQ ID NO: 158) |
| QAVEVWQGLALLS, (SEQ ID NO: 159) | AVEVWQGLALLSE, (SEQ ID NO: 160) | VEVWQGLALLSEA, (SEQ ID NO: 161) | EVWQGLALLSEAV, (SEQ ID NO: 162) | VWQGLALLSEAVL, (SEQ ID NO: 163) |
| WQGLALLSEAVLR, (SEQ ID NO: 164) | QGLALLSEAVLRG, (SEQ ID NO: 165) | LALLSEAVLRGQA, (SEQ ID NO: 166) | ALLSEAVLRGQAL, (SEQ ID NO: 167) | LSEAVLRGQALLV, (SEQ ID NO: 168) |
| SEAVLRGQALLVN, (SEQ ID NO: 169) | EAVLRGQALLVNS, (SEQ ID NO: 170) | AVLRGQALLVNSS, (SEQ ID NO: 171) | QALLVNSSQPWEP, (SEQ ID NO: 172) | ALLVNSSQPWEPL, (SEQ ID NO: 173) |
| LLVNSSQPWEPLQ, (SEQ ID NO: 174) | QPWEPLQLHVDKA, (SEQ ID NO: 175) | EPLQLHVDKAVSG, (SEQ ID NO: 176) | LQLHVDKAVSGLR, (SEQ ID NO: 177) | LHVDKAVSGLRSL, (SEQ ID NO: 178) |
| KAVSGLRSLTTLL, (SEQ ID NO: 179) | SGLRSLTTLLRAL, (SEQ ID NO: 180) | RSLTTLLRALGAQ, (SEQ ID NO: 181) | SLTTLLRALGAQK, (SEQ ID NO: 182) | TTLLRALGAQKEA, (SEQ ID NO: 183) |
| TLLRALGAQKEAI, (SEQ ID NO: 184) | RALGAQKEAISPP, (SEQ ID NO: 185) | AQKEAISPPDAAS, (SEQ ID NO: 186) | EAISPPDAASAAP, (SEQ ID NO: 187) | SPPDAASAAPLRT, (SEQ ID NO: 188) |
| ASAAPLRTITADT, (SEQ ID NO: 189) | APLRTITADTFRK, (SEQ ID NO: 190) | RTITADTFRKLFR, (SEQ ID NO: 191) | TITADTFRKLFRV, (SEQ ID NO: 192) | DTFRKLFRVYSNF, (SEQ ID NO: 193) |
| RKLFRVYSNFLRG, | KLFRVYSNFLRGK, | FRVYSNFLRGKLK, | RVYSNFLRGKLKL, | YSNFLRGKLKLYT, |

TABLE 7-continued

| | | | | |
|---|---|---|---|---|
| (SEQ ID NO: 194) | (SEQ ID NO: 195) | (SEQ ID NO: 196) | (SEQ ID NO: 197) | (SEQ ID NO: 198) |
| SNFLRGKLKLYTG, (SEQ ID NO: 199) | NFLRGKLKLYTGE, (SEQ ID NO: 200) | RGKLKLYTGEACR, (SEQ ID NO: 201) | GKLKLYTGEACRT, (SEQ ID NO: 202) | LKLYTGEACRTGD, (SEQ ID NO: 203) |
| KLYTGEACRTGDR. (SEQ ID NO: 204) | | | | |

Substitutions leading to the elimination of potential T-cell epitopes of human erythropoietin (EPO) (WT=wild type) are shown in Table 8.

TABLE 8

| Residue # | WT residue | Substitutions |
|---|---|---|
| 5 | L | A C D E G H K N P Q R S T |
| 6 | I | A C D E G H K N P Q R S T |
| 11 | V | A C D E G H K N P Q R S T |
| 12 | L | A C D E G H K N P Q R S T |
| 15 | Y | A C D E G H K N P Q R S T |
| 16 | L | A C D E G H K N P Q R S T |
| 17 | L | A C D E G H K N P Q R S T |
| 25 | I | A C D E G H K N P Q R S T |
| 35 | L | A C D E G H K N P Q R S T |
| 39 | I | A C D E G H K N P Q R S T |
| 41 | V | A C D E G H K N P Q R S T |
| 46 | V | A C D E G H K N P Q R S T |
| 48 | F | A C D E G H K N P Q R S T |
| 49 | Y | A C D E G H K N P Q R S T |
| 51 | W | A C D E G H K N P Q R S T |
| 54 | M | A C D E G H K N P Q R S T |
| 56 | V | A C D E G H K N P Q R S T |
| 61 | V | A C D E G H K N P Q R S T |
| 63 | V | A C D E G H K N P Q R S T |
| 64 | W | A C D E G H K N P Q R S T |
| 67 | L | A C D E G H K N P Q R S T |
| 69 | L | A C D E G H K N P Q R S T |
| 70 | L | A C D E G H K N P Q R S T |
| 74 | V | A C D E G H K N P Q R S T |
| 75 | L | A C D E G H K N P Q R S T |
| 80 | L | A C D E G H K N P Q R S T |
| 81 | L | A C D E G H K N P Q R S T |
| 82 | N | A C D E G H K N P Q R S T |
| 88 | W | A C D E G H K N P Q R S T |
| 91 | L | A C D E G H K N P Q R S T |
| 93 | L | A C D E G H K N P Q R S T |
| 95 | V | A C D E G H K N P Q R S T |
| 99 | V | A C D E G H K N P Q R S T |
| 102 | L | A C D E G H K N P Q R S T |
| 105 | L | A C D E G H K N P Q R S T |
| 108 | L | A C D E G H K N P Q R S T |
| 109 | L | A C D E G H K N P Q R S T |
| 112 | L | A C D E G H K N P Q R S T |
| 119 | I | A C D E G H K N P Q R S T |
| 130 | L | A C D E G H K N P Q R S T |
| 133 | I | A C D E G H K N P Q R S T |
| 138 | F | A C D E G H K N P Q R S T |
| 141 | L | A C D E G H K N P Q R S T |
| 142 | F | A C D E G H K N P Q R S T |
| 144 | V | A C D E G H K N P Q R S T |
| 145 | Y | A C D E G H K N P Q R S T |
| 148 | F | A C D E G H K N P Q R S T |
| 149 | L | A C D E G H K N P Q R S T |
| 153 | L | A C D E G H K N P Q R S T |
| 155 | L | A C D E G H K N P Q R S T |
| 156 | Y | A C D E G H K N P Q R S T |

EXAMPLE 8

(G-CSF)

Granulocyte colony stimulating factor (G-CSF) is an important haemopoietic cytokine currently used in treatment of indications where an increase in blood neutrophils will provide benefits. These include cancer therapy, various infectious diseases and related conditions such as sepsis. G-CSF is also used alone, or in combination with other compounds and cytokines in the ex vivo expansion of haemopoeitic cells for bone marrow transplantation. Two forms of human G-CSF are commonly recognized for this cytokine. One is a protein of 177 amino acids, the other a protein of 174 amino acids Nagata, et al., (1986), *EMBO J.* 5:575-581] the 174 amino acid form has been found to have the greatest specific in vivo biological activity. Recombinant DNA techniques have enabled the production of commercial scale quantities of G-CSF exploiting both eukaryotic and prokaryotic host cell expression systems.

The amino acid sequence of human granulocyte colony stimulating factor (G-CSF) (depicted as one-letter code) is as follows:

```
TPLGPASSLPQSFLLKCLEQVRKIQGDGAALQEK

LCATYKLCHPEELVLLGHSLGIPWAPLSSCPSQA

LQLAGCLSQLHSGLFLYQGLLQALEGISPELGPT

LDTLQLDVADFATTIWQQMEELGMAPALQPTQGA

MPAFASAFQRRAGGVLVASHLQSFLEVSYRVLRH

LAQP.
(SEQ ID NO: 205)
```

Other polypeptide analogues and peptide fragments of G-CSF have been previously disclosed, including forms modified by site-specific amino acid substitutions and or by modification by chemical adducts. Thus U.S. Pat. No. 4,810,643 discloses analogues with the particular Cys residues replaced with another amino acid, and G-CSF with an Ala residue in the first (N-terminal) position. EP 0335423 discloses the modification of at least one amino group in a polypeptide having G-CSF activity. EP 0272703 discloses G-CSF derivatives having amino acid substituted or deleted near the N terminus. EP 0459630 discloses G-CSF derivatives in which Cys 17 and Asp 27 are replaced by Ser residues. EP 0 243 153 discloses G-CSF modified by inactivating at least one yeast KEX2 protease processing site for increased yield in recombinant production and U.S. Pat. No. 4,904,584 discloses lysine altered proteins. WO 90/12874 discloses further Cys altered variants and Australian patent document AU 10948/92 discloses the addition of amino acids to either terminus of a G-CSF molecule for the purpose of aiding in the folding of the molecule after prokaryotic expression. AU-76380/91, discloses G-CSF variants at positions 50-56 of the G-CSF 174 amino acid form, and positions 53-59 of the 177 amino acid form. Additional changes at particular His residues were also disclosed.

An amino acid sequence which is part of the sequence of an immunogenically non-modified human granulocyte colony stimulating factor (G-CSF) and has a potential MHC class II binding activity is selected from the following group shown in Table 9.

TABLE 9

| | | | |
|---|---|---|---|
| TPLGPASSLPQSF, (SEQ ID NO: 206) | SSLPQSFLLKCLE, (SEQ ID NO: 207) | QSFLLKCLEQVRK, (SEQ ID NO: 208) | SFLLKCLEQVRKI, (SEQ ID NO: 209) |
| FLLKCLEQVRKIQ, (SEQ ID NO: 210) | KCLEQVRKIQGDG, (SEQ ID NO: 211) | EQVRKIQGDGAAL, (SEQ ID NO: 212) | RKIQGDGAALQEK, (SEQ ID NO: 213) |
| AALQEKLVSECAT, (SEQ ID NO: 214) | EKLVSECATYKLC, (SEQ ID NO: 215) | KLVSECATYKLCH, (SEQ ID NO: 216) | AALQEKLCATYKL, (SEQ ID NO: 217) |
| EKLCATYKLCHPE, (SEQ ID NO: 218) | ATYKLCHPEELVL, (SEQ ID NO: 219) | YKLCHPEELVLLG, (SEQ ID NO: 220) | EELVLLGHSLGIP, (SEQ ID NO: 221) |
| ELVLLGHSLGIPW, (SEQ ID NO: 222) | HSLGIPWAPLSSC, (SEQ ID NO: 223) | IPWAPLSSCPSQA, (SEQ ID NO: 224) | APLSSCPSQALQL, (SEQ ID NO: 225) |
| QALQLAGCLSQLH, (SEQ ID NO: 226) | GCLSQLHSGLFLY, (SEQ ID NO: 227) | SQLHSGLFLYQGL, (SEQ ID NO: 228) | SGLFLYQGLLQAL, (SEQ ID NO: 229) |
| GLFLYQGLLQALE, (SEQ ID NO: 230) | LFLYQGLLQALEG, (SEQ ID NO: 231) | FLYQGLLQALEGI, (SEQ ID NO: 232) | QGLLQALEGISPE, (SEQ ID NO: 233) |
| GLLQALEGISPEL, (SEQ ID NO: 234) | QALEGISPELGPT, (SEQ ID NO: 235) | EGISPELGPTLDT, (SEQ ID NO: 236) | PTLDTLQLDVADF, (SEQ ID NO: 237) |
| DTLQLDVADFATT, (SEQ ID NO: 238) | LQLDVADFATTIW, (SEQ ID NO: 239) | LDVADFATTIWQQ, (SEQ ID NO: 240) | TTIWQQMEELGMA, (SEQ ID NO: 241) |
| TIWQQMEELGMAP, (SEQ ID NO: 242) | QQMEELGMAPALQ, (SEQ ID NO: 243) | EELGMAPALQPTQ, (SEQ ID NO: 244) | LGMAPALQPTQGA, (SEQ ID NO: 245) |
| PALQPTQGAMPAF, (SEQ ID NO: 246) | GAMPAFASAFQRR, (SEQ ID NO: 247) | PAFASAFQRRAGG, (SEQ ID NO: 248) | SAFQRRAGGVLVA, (SEQ ID NO: 249) |
| GGVLVASHLQSFL, (SEQ ID NO: 250) | GVLVASHLQSFLE, (SEQ ID NO: 251) | VLVASHLQSFLEV, (SEQ ID NO: 252) | SHLQSFLEVSYRV, (SEQ ID NO: 253) |
| QSFLEVSYRVLRH, (SEQ ID NO: 254) | SFLEVSYRVLRHL, (SEQ ID NO: 255) | LEVSYRVLRHLAQ. (SEQ ID NO: 256) | |

Any of the above-cited peptide sequences can be used for modifying by exchanging one or more amino acids to obtain a sequence having a reduced or no immunogenicity.

Substitutions leading to the elimination of potential T-cell epitopes of human granulocyte colony stimulating factor (G-CSF) (WT=wild type) are shown in Table 10.

TABLE 10

| Residue # | WT Residue | Substitution |
|---|---|---|
| 3 | L | A C D E G H K N P O R S T |
| 9 | L | A C D E G H K N P Q R S T |
| 14 | L | A C D E G H K N P Q R S T |
| 15 | L | A C D E G H K N P Q R S T |
| 18 | L | A C D E G H K N P Q R S T |
| 21 | V | A C D E G H K N P Q R S T |
| 24 | I | A C D E G H K N P Q R S T |
| 31 | L | A C D E G H K N P Q R S T |
| 35 | L | A C D E G H K N P Q R S T |
| 39 | Y | A C D E G H K N P Q R S T |
| 41 | L | A C D E G H K N P Q R S T |
| 47 | L | A C D E G H K N P Q R S T |
| 48 | V | A C D E G H K N P Q R S T |
| 49 | L | A C D E G H K N P Q R S T |
| 50 | L | A C D E G H K N P Q R S T |
| 54 | L | A C D E G H K N P Q R S T |
| 56 | I | A C D E G H K N P Q R S T |
| 58 | W | A C D E G H K N P Q R S T |
| 61 | L | A C D E G H K N P Q R S T |
| 69 | L | A C D E G H K N P Q R S T |
| 71 | L | A C D E G H K N P Q R S T |
| 75 | L | A C D E G H K N P Q R S T |
| 78 | L | A C D E G H K N P Q R S T |
| 82 | L | A C D E G H K N P Q R S T |
| 83 | F | A C D E G H K N P Q R S T |
| 84 | L | A C D E G H K N P Q R S T |
| 85 | Y | A C D E G H K N P Q R S T |
| 88 | L | A C D E G H K N P Q R S T |
| 89 | L | A C D E G H K N P Q R S T |
| 92 | L | A C D E G H K N P Q R S T |
| 95 | I | A C D E G H K N P Q R S T |
| 99 | L | A C D E G H K N P Q R S T |
| 103 | L | A C D E G H K N P Q R S T |
| 106 | L | A C D E G H K N P Q R S T |
| 108 | L | A C D E G H K N P Q R S T |
| 110 | V | A C D E G H K N P Q R S T |
| 113 | F | A C D E G H K N P Q R S T |
| 117 | I | A C D E G H K N P Q R S T |
| 118 | W | A C D E G H K N P Q R S T |
| 121 | M | A C D E G H K N P Q R S T |
| 124 | L | A C D E G H K N P Q R S T |
| 130 | L | A C D E G H K N P Q R S T |
| 137 | M | A C D E G H K N P Q R S T |
| 140 | F | A C D E G H K N P Q R S T |
| 144 | F | A C D E G H K N P Q R S T |
| 151 | V | A C D E G H K N P Q R S T |
| 152 | L | A C D E G H K N P Q R S T |
| 153 | V | A C D E G H K N P Q R S T |
| 157 | L | A C D E G H K N P Q R S T |
| 160 | F | A C D E G H K N P Q R S T |
| 161 | L | A C D E G H K N P Q R S T |
| 163 | V | A C D E G H K N P Q R S T |

EXAMPLE 9

(KGF)

Another valuable molecule is keratinocyte growth factor (KGF). KGF is a member of the fibroblast growth factor (FGF)/heparin-binding growth factor family of proteins. It is a secreted glycoprotein expressed predominantly in the lung, promoting wound healing by stimulating the growth of keratinocytes and other epithelial cells Finch et al., (1989), *Science* 24: 752-755; Rubin, et al., (1989), *Proc. Natl. Acad. Sci. U.S.A.,* 86: 802-806]. The mature (processed) form of the glycoprotein comprises 163 amino acid residues and may be isolated from conditioned media following culture of particular cell lines [Rubin et al, (1989) ibid.], or produced using recombinant techniques [Ron et al., (1993) *J. Biol. Chem.* 268: 2984-2988]. The protein is of therapeutic value for the stimulation of epithelial cell growth in a number of significant disease and injury repair settings. This disclosure specifically pertains the human KGF protein being the mature (processed) form of 163 amino acid residues.

Others have also provided KGF molecules [e.g. U.S. Pat. No. 6,008,328; WO90/08771;] including modified KGF [Ron et al (1993) ibid; WO9501434]. However, such teachings have not recognized the importance of T-cell epitopes to the immunogenic properties of the protein nor have been conceived to directly influence said properties in a specific and controlled way according to the scheme of the present invention.

The amino acid sequence of keratinocyte growth factor (KGF) (depicted as one-letter code) is as follows:

MCNDMTPEQMATNVNCSSPERHTRSYDYMEGGDI

RVRRLFCRTQWYLRIDKRGKVKGTQEMKNNYNIM

EIRTVAVGIVAIKGVESEFYLAMNKEGKLYAKKE

CNEDCNFKELILENHYNTYASAKWTHNGGEMFVA

LNQKGIPVRGKKTKKEQKTAHFLPMAIT.
(SEQ ID NO: 257)

An amino acid sequence which is part of the sequence of an immunogenically non-modified human keratinocyte growth factor (KFG) and has a potential MHC class II binding activity is selected from the following group shown in Table 11.

TABLE 11

NDMTPEQMATNVN, DMTPEQMATNVNC, EQMATNVNCSSPE, TNVNCSSPERHTR,
(SEQ ID NO: 258) (SEQ ID NO: 259) (SEQ ID NO: 260) (SEQ ID NO: 261)

RSYDYMEGGDIRV, YDYMEGGDIRVRR, DYMEGGDIRVRRL, GDIRVRRLFCRTQ,
(SEQ ID NO: 262) (SEQ ID NO: 263) (SEQ ID NO: 264) (SEQ ID NO: 265)

IRVRRLFCRTQWY, RRLFCRTQWYLRI, RLFCRTQWYLRID, TQWYLRIDKRGKV,
(SEQ ID NO: 266) (SEQ ID NO: 267) (SEQ ID NO: 268) (SEQ ID NO: 269)

QWYLRIDKRGKVK, WYLRIDKRGKVKG, LRIDKRGKVKGTQ, GKVKGTQEMKNNY,
(SEQ ID NO: 270) (SEQ ID NO: 271) (SEQ ID NO: 272) (SEQ ID NO: 273)

QEMKNNYNIMEIR, NNYNIMEIRTVAV, YNIMEIRTVAVGI, NIMEIRTVAVGIV,
(SEQ ID NO: 274) (SEQ ID NO: 275) (SEQ ID NO: 276) (SEQ ID NO: 277)

MEIRTVAVGIVAI, RTVAVGIVAIKGV, VAVGIVAIKGVES, VGIVAIKGVESEF,
(SEQ ID NO: 278) (SEQ ID NO: 279) (SEQ ID NO: 280) (SEQ ID NO: 281)

VAIKGVESEFYLA, KGVESEFYLAMNK, SEFYLAMNKEGKL, EFYLAMNKEGKLY,
(SEQ ID NO: 282) (SEQ ID NO: 283) (SEQ ID NO: 284) (SEQ ID NO: 285)

FYLAMNKEGKLYA, LAMNKEGKLYAKK, GKLYAKKECNEDC, KLYAKKECNEDCN,
(SEQ ID NO: 286) (SEQ ID NO: 287) (SEQ ID NO: 288) (SEQ ID NO: 289)

CNFKELILENHYN, KELILENHYNTYA, ELILENHYNTYAS, LILENHYNTYASA,
(SEQ ID NO: 290) (SEQ ID NO: 291) (SEQ ID NO: 292) (SEQ ID NO: 293)

NHYNTYASAKWTH, NTYASAKWTHNGG, AKWTHNGGEMFVA, GEMFVALNQKGIP,
(SEQ ID NO: 294) (SEQ ID NO: 295) (SEQ ID NO: 296) (SEQ ID NO: 297)

EMFVALNQKGIPV, FVALNQKGIPVRG, VALNQKGIPVRGK, KGIPVRGKKTKKE,
(SEQ ID NO: 298) (SEQ ID NO: 299) (SEQ ID NO: 300) (SEQ ID NO: 301)

IPVRGKKTKKEQK, KTKKEQKTAHFLP.
(SEQ ID NO: 302) (SEQ ID NO: 303)

Any of the above-cited peptide sequences can be used for modifying by exchanging one or more amino acids to obtain a sequence having a reduced or no immunogenicity.

Substitutions leading to the elimination of potential T-cell epitopes of human keratinocyte growth factor (KGF) (WT=wild type) are shown in Table 12.

TABLE 12

| Residue # | WT residue | Substitution |
|---|---|---|
| 5 | M | A C D E G H K N P Q R S T |
| 10 | M | A C D E G H K N P Q R S T |
| 14 | V | A C D E G H K N P Q R S T |
| 26 | Y | A C D E G H K N P Q R S T |
| 28 | Y | A C D E G H K N P Q R S T |
| 29 | M | A C D E G H K N P Q R S T |
| 34 | I | A C D E G H K N P Q R S T |
| 36 | V | A C D E G H K N P Q R S T |
| 39 | L | A C D E G H K N P Q R S T |
| 40 | F | A C D E G H K N P Q R S T |
| 45 | W | A C D E G H K N P Q R S T |
| 46 | Y | A C D E G H K N P Q R S T |
| 47 | L | A C D E G H K N P Q R S T |
| 49 | I | A C D E G H K N P Q R S T |
| 55 | V | A C D E G H K N P Q R S T |
| 61 | M | A C D E G H K N P Q R S T |
| 65 | Y | A C D E G H K N P Q R S T |

TABLE 12-continued

| Residue # | WT residue | Substitution |
|---|---|---|
| 67 | I | A C D E G H K N P Q R S T |
| 68 | M | A C D E G H K N P Q R S T |
| 70 | I | A C D E G H K N P Q R S T |
| 73 | V | A C D E G H K N P Q R S T |
| 75 | V | A C D E G H K N P Q R S T |
| 77 | I | A C D E G H K N P Q R S T |
| 78 | V | A C D E G H K N P Q R S T |
| 80 | I | A C D E G H K N P Q R S T |
| 83 | V | A C D E G H K N P Q R S T |
| 87 | F | A C D E G H K N P Q R S T |
| 88 | Y | A C D E G H K N P Q R S T |
| 89 | L | A C D E G H K N P Q R S T |
| 91 | M | A C D E G H K N P Q R S T |
| 97 | L | A C D E G H K N P Q R S T |
| 98 | Y | A C D E G H K N P Q R S T |
| 109 | F | A C D E G H K N P Q R S T |
| 112 | L | A C D E G H K N P Q R S T |
| 113 | I | A C D E G H K N P Q R S T |
| 114 | L | A C D E G H K N P Q R S T |
| 118 | Y | A C D E G H K N P Q R S T |
| 121 | Y | A C D E G H K N P Q R S T |
| 126 | W | A C D E G H K N P Q R S T |
| 133 | M | A C D E G H K N P Q R S T |
| 134 | F | A C D E G H K N P Q R S T |
| 135 | V | A C D E G H K N P Q R S T |
| 137 | L | A C D E G H K N P Q R S T |
| 142 | I | A C D E G H K N P Q R S T |
| 144 | V | A C D E G H K N P Q R S T |

EXAMPLE 10

(Soluble TNF RI)

The sTNF-RI (soluble tumor necrosis factor receptor type I) is a derivative of the human tumor necrosis factor receptor described previously [Gray, P. W. et al (1990) *Proc. Nat. Acad. Sci. U.S.A.* 87: 7380-7384; Loetschere, H. et al, (1990) *Cell* 61: 351-359; Schall, T. J. et al (1990) *Cell* 61:361-370], comprising the extracellular domain of the intact receptor and exhibiting an approximate molecular weight of 30 KDa. Additional soluble TNF inhibitors and in particular a 40 KDa form are also known [U.S. Pat. No. 6,143,866]. The soluble forms are able to bind tumor necrosis factor alpha with high affinity and inhibit the cytotoxic activity of the cytokine in vitro. Recombinant preparations of sTNF-RI are of significant therapeutic value for the treatment of diseases where an excess level of tumor necrosis factor is causing a pathogenic effect. Indications such as cachexia, sepsis and autoimmune disorders including, and in particular, rheumatoid arthritis and others may be targeted by such therapeutic preparations of sTNF-RI. Others including Brewer et al., U.S. Pat. No. 6,143,866, have provided modified sTNF-RI molecules.

Peptide sequences in a human 30 KDa sTNF-RI with potential human MHC class II binding activity shown in Table 13.

TABLE 13

| | | | |
|---|---|---|---|
| DSVCPQGKYIHPQ, (SEQ ID NO: 304) | KYIHPQNNSICCT, (SEQ ID NO: 305) | NSICCTKCHKGTY, (SEQ ID NO: 306) | TYLYNDCPGPGQD, (SEQ ID NO: 307) |
| YLYNDCPGPGQDT, (SEQ ID NO: 308) | NHLRHCLSCSKCR, (SEQ ID NO: 309) | HCLSCSKCRKEMG, (SEQ ID NO: 310) | KEMGQVEISSCTV, (SEQ ID NO: 311) |
| GQVEISSCTVDRD, (SEQ ID NO: 312) | VEISSCTVDRDTV, (SEQ ID NO: 313) | CTVDRDTVCGCRK, (SEQ ID NO: 314) | DTVCGCRKNQYRH, (SEQ ID NO: 315) |
| NQYRHYWSENLFQ, (SEQ ID NO: 316) | RHYWSENLFQCFN, (SEQ ID NO: 317) | HYWSENLFQCFNC, (SEQ ID NO: 318) | ENLFQCFNCSLCL, (SEQ ID NO: 319) |
| NLFQCFNCSLCLN, (SEQ ID NO: 320) | QCFNCSLCLNGTV, (SEQ ID NO: 321) | CSLCLNGTVHLSC, (SEQ ID NO: 322) | LCLNGTVHLSCQE, (SEQ ID NO: 323) |
| GTVHLSCQEKQNT, (SEQ ID NO: 324) | VHLSCQEKQNTVC, (SEQ ID NO: 325) | EKQNTVCTCHAGF, (SEQ ID NO: 326) | NTVCTCHAGFFLR, (SEQ ID NO: 327) |
| GFFLRENECVSCS, (SEQ ID NO: 328) | FFLRENECVSCSN, (SEQ ID NO: 329) | ECVSCSNCKKSLE, (SEQ ID NO: 330) | KSLECTKLCLPQI, (SEQ ID NO: 331) |
| TKLCLPQIENVKG, (SEQ ID NO: 332) | LCLPQIENVKGTE, (SEQ ID NO: 333) | PQIENVKGTEDSG, (SEQ ID NO: 334) | SGTTVLLPLVIFF. (SEQ ID NO: 335) |

Any of the above-cited peptide sequences can be used for modifying by exchanging one or more ammo acids to obtain a sequence having a reduced or no immunogenicity.

EXAMPLE 11

(Soluble TNF R2)

Soluble tumor necrosis factor receptor 2 (sTNF-R2) is a derivative of the human tumor necrosis factor receptor 2 described previously [Smith, C. A. et al (1990) *Science* 248: 1019-1023; Kohno, T. et al (1990) *Proc. Nat. Acad. Sci. U.S.A.* 87: 8331-8335; Beltinger, C. P. et al (1996) *Genomics* 35: 94-100] comprising the extracellular domain of the intact receptor. The soluble forms are able to bind tumour necrosis factor with high affinity and inhibit the cytotoxic activity of the cytokine in vitro. Recombinant preparations of sTNF-R2 are of significant therapeutic value for the treatment of diseases where an excess level of tumour necrosis factor is causing a pathogenic effect. A particular recombinant preparation termed ethanercept has gained clinical approval for the treatment of rheumatoid arthritis and this and other similar agents may be of value in the treatment of other indications such as cachexia, sepsis and autoimmune disorders. Ethanercept is a dimeric fusion protein comprising the extracellular domain of the human TNFR2 molecule in combination with the Fc domain of the human IgG1 molecule. The dimeric molecule comprises 934 amino acids [U.S. Pat. Nos. 5,395,760; 5,605,690; 5,945,397, RE36,755].

Peptide sequences in the TNF binding domain of the human TNFR2 protein with potential human MHC class II binding activity are shown in Table 14.

EXAMPLE 12

(β-GCR)

Beta-Glucocerebrosidase (b-D-glucosyl-N-acylsphingosine glucohydrolase, E.C. 3.2.1.45) is a monomeric glycoprotein of 497 amino acid residues. The enzyme catalyses the hydrolysis of the glycolipid glucocerebroside to glucose and ceramide. Deficiency in GCR activity results in a lysosomal storage disease referred to as Gaucher disease. The disease is characterised by the accumulation of glucocerebroside engorged tissue macrophages that accumulate in the liver, spleen, bone marrow and other organs. The disease has varying degrees of severity from type 1 disease with haematologic problems but no neuronal involvement, to type 2 disease manifesting early after birth with extensive neuronal involvement and is universally progressive and fatal within 2 years of age. Type 3 disease is also recognised in some classifications and also shows neurologic involvement. Previously the only useful therapy for Gaucher disease has been administration of GCR derived from human placenta (known as alglucerase) but more recently pharmaceutical preparations of recombinant GCR ("ceredase" and "cerezyme") have shown efficacy in the treatment of type I disease [Niederau, C. et al. (1998) *Eur. J. Med. Res.* 3: 25-30].

Peptide sequences in human GCR with potential human MHC class II binding activity are shown in Table 15.

TABLE 14

| | | | |
|---|---|---|---|
| TPYAPEPGSTCRL, (SEQ ID NO: 336) | CRLREYYDQTAQM, (SEQ ID NO: 337) | REYYDQTAQMCCS, (SEQ ID NO: 338) | EYYDQTAQMCCSK, (SEQ ID NO: 339) |
| AQMCCSKCSPGQH, (SEQ ID NO: 340) | KCSPGQHAKVFCT, (SEQ ID NO: 341) | AKVFCTKTSDTVC, (SEQ ID NO: 342) | KVFCTKTSDTVCD, (SEQ ID NO: 343) |
| STYTQLWNWVPEC, (SEQ ID NO: 344) | TQLWNWVPECLSC, (SEQ ID NO: 345) | QLWNWVPECLSCG, (SEQ ID NO: 346) | NWVPECLSCGSRC, (SEQ ID NO: 347) |
| ECLSCGSRCSSDQ, (SEQ ID NO: 348) | SRCSSDQEVTQAC, (SEQ ID NO: 349) | QEVTQACTREQNR, (SEQ ID NO: 350) | QNRICTCRPGWYC, (SEQ ID NO: 351) |
| NRICTCRPGWYCA, (SEQ ID NO: 352) | PGWYCALSKQEGC, (SEQ ID NO: 353) | GWYCALSKQEGCR, (SEQ ID NO: 354) | CALSKQEGCRLCA, (SEQ ID NO: 355) |
| APLRKCRPGFGVA, (SEQ ID NO: 356) | PGFGVARPGTETS, (SEQ ID NO: 357) | FGVARPGTETSDV, (SEQ ID NO: 358) | SDVVCKPCAPGTF, (SEQ ID NO: 359) |
| GTFSNTTSSTDIC, (SEQ ID NO: 360) | TDICRPHQICNVV, (SEQ ID NO: 361) | HQICNVVAIPGNA, (SEQ ID NO: 362) | ICNVVAIPGNASR, (SEQ ID NO: 363) |
| CNVVAIPGNASRD, (SEQ ID NO: 364) | NVVAIPGNASRDA, (SEQ ID NO: 365) | VAIPGNASRDAVC, (SEQ ID NO: 366) | DAVCTSTTTPTRS, (SEQ ID NO: 367) |
| TRSMAPGAVHLPQ, (SEQ ID NO: 368) | RSMAPGAVHLPQP, (SEQ ID NO: 369) | VHLPQPVSTRSQH, (SEQ ID NO: 370) | QPVSTRSQHTQPT, (SEQ ID NO: 371) |
| PEPSTAPSTSFLL, (SEQ ID NO: 372) | SFLLPMGPSPPAE, (SEQ ID NO: 373) | FLLPMGPSPPAEG. (SEQ ID NO: 374) | |

TABLE 15

| | | | | |
|---|---|---|---|---|
| PCIPKSFGYSSVV, (SEQ ID NO: 375) | KSFGYSSVVCVCN, (SEQ ID NO: 376) | FGYSSVVCVCNAT, (SEQ ID NO: 377) | SSVVCVCNATYCD, (SEQ ID NO: 378) | SVVCVCNATYCDS, (SEQ ID NO: 379) |
| VCVCNATYCDSFD, (SEQ ID NO: 380) | ATYCDSFDPPTFP, (SEQ ID NO: 381) | DSFDPPTFPALGT, (SEQ ID NO: 382) | PTFPALGTFSRYE, (SEQ ID NO: 383) | PALGTFSRYESTR, (SEQ ID NO: 384) |
| GTFSRYESTRSGR, (SEQ ID NO: 385) | SRYESTRSGRRME, (SEQ ID NO: 386) | GRRMELSMGPIQA, (SEQ ID NO: 387) | RRMELSMGPIQAN, (SEQ ID NO: 388) | RMELSMGPIQANH, (SEQ ID NO: 389) |
| MELSMGPIQANHT, (SEQ ID NO: 390) | LSMGPIQANHTGT, (SEQ ID NO: 391) | MGPIQANHTGTGL, (SEQ ID NO: 392) | GPIQANHTGTGLL, (SEQ ID NO: 393) | TGLLLTLQPEQKF, (SEQ ID NO: 394) |
| GLLLTLQPEQKFQ, (SEQ ID NO: 395) | LLLTLQPEQKFQK, (SEQ ID NO: 396) | LTLQPEQKFQKVK, (SEQ ID NO: 397) | TLQPEQKFQKVKG, (SEQ ID NO: 398) | PEQKFQKVKGFGG, (SEQ ID NO: 399) |
| QKFQKVKGFGGAM, (SEQ ID NO: 400) | QKVKGFGGAMTDA, (SEQ ID NO: 401) | KGFGGAMTDAAAL, (SEQ ID NO: 402) | GFGGAMTDAAALN, (SEQ ID NO: 403) | GAMTDAAALNILA, (SEQ ID NO: 404) |
| AMTDAAALNILAL, (SEQ ID NO: 405) | MTDAAALNILALS, (SEQ ID NO: 406) | AALNILALSPPAQ, (SEQ ID NO: 407) | ALNILALSPPAQN, (SEQ ID NO: 408) | LNILALSPPAQNL, (SEQ ID NO: 409) |
| NILALSPPAQNLL, (SEQ ID NO: 410) | LALSPPAQNLLLK, (SEQ ID NO: 411) | ALSPPAQNLLLKS, (SEQ ID NO: 412) | PAQNLLLKSYFSE, (SEQ ID NO: 413) | AQNLLLKSYFSEE, (SEQ ID NO: 414) |
| QNLLLKSYFSEEG, (SEQ ID NO: 415) | NLLLKSYFSEEGI, (SEQ ID NO: 416) | LLLKSYFSEEGIG, (SEQ ID NO: 417) | KSYFSEEGIGYNI, (SEQ ID NO: 418) | SYFSEEGIGYNII, (SEQ ID NO: 419) |
| FSEEGIGYNIIRV, (SEQ ID NO: 420) | EGIGYNIIRVPMA, (SEQ ID NO: 421) | GIGYNIIRVPMAS, (SEQ ID NO: 422) | IGYNIIRVPMASC, (SEQ ID NO: 423) | YNIIRVPMASCDF, (SEQ ID NO: 424) |
| NIIRVPMASCDFS, (SEQ ID NO: 425) | IIRVPMASCDFSI, (SEQ ID NO: 426) | IRVPMASCDFSIR, (SEQ ID NO: 427) | VPMASCDFSIRTY, (SEQ ID NO: 428) | PMASCDFSIRTYT, (SEQ ID NO: 429) |
| SCDFSIRTYTYAD, (SEQ ID NO: 430) | CDFSIRTYTYADT, (SEQ ID NO: 431) | FSIRTYTYADTPD, (SEQ ID NO: 432) | RTYTYADTPDDFQ, (SEQ ID NO: 433) | TYTYADTPDDFQL, (SEQ ID NO: 434) |
| YTYADTPDDFQLH, (SEQ ID NO: 435) | ADTPDDFQLHNFS, (SEQ ID NO: 436) | PDDFQLHNFSLPE, (SEQ ID NO: 437) | DDFQLHNFSLPEE, (SEQ ID NO: 438) | FQLHNFSLPEEDT, (SEQ ID NO: 439) |
| HNFSLPEEDTKLK, (SEQ ID NO: 440) | FSLPEEDTKLKIP, (SEQ ID NO: 441) | SLPEEDTKLKIPL, (SEQ ID NO: 442) | EEDTKLKIPLIHR, (SEQ ID NO: 443) | TKLKIPLIHRALQ, (SEQ ID NO: 444) |
| KLKIPLIHRALQL, (SEQ ID NO: 445) | LKIPLIHRALQLA, (SEQ ID NO: 446) | IPLIHRALQLAQR, (SEQ ID NO: 447) | PLIHRALQLAQRP, (SEQ ID NO: 448) | HRALQLAQRPVSL, (SEQ ID NO: 449) |
| RALQLAQRPVSLL, (SEQ ID NO: 450) | ALQLAQRPVSLLA, (SEQ ID NO: 451) | LQLAQRPVSLLAS, (SEQ ID NO: 452) | RPVSLLASPWTSP, (SEQ ID NO: 453) | PVSLLASPWTSPT, (SEQ ID NO: 454) |
| VSLLASPWTSPTW, (SEQ ID NO: 455) | SLLASPWTSPTWL, (SEQ ID NO: 456) | SPWTSPTWLKTNG, (SEQ ID NO: 457) | TSPTWLKTNGAVN, (SEQ ID NO: 458) | PTWLKTNGAVNGK, (SEQ ID NO: 459) |
| TWLKTNGAVNGKG, (SEQ ID NO: 460) | GAVNGKGSLKGQP, (SEQ ID NO: 461) | GSLKGQPGDIYHQ, (SEQ ID NO: 462) | GDIYHQTWARYFV, (SEQ ID NO: 463) | DIYHQTWARYFVK, (SEQ ID NO: 464) |
| QTWARYFVKFLDA, (SEQ ID NO: 465) | WARYFVKFLDAYA, (SEQ ID NO: 466) | ARYFVKFLDAYAE, (SEQ ID NO: 467) | RYFVKFLDAYAEH, (SEQ ID NO: 468) | YFVKFLDAYAEHK, (SEQ ID NO: 469) |
| FVKFLDAYAEHKL, (SEQ ID NO: 470) | VKFLDAYAEHKLQ, (SEQ ID NO: 471) | KFLDAYAEHKLQF, (SEQ ID NO: 472) | DAYAEHKLQFWAV, (SEQ ID NO: 473) | YAEHKLQFWAVTA, (SEQ ID NO: 474) |
| HKLQFWAVTAENE, (SEQ ID NO: 475) | LQFWAVTAENEPS, (SEQ ID NO: 476) | QFWAVTAENEPSA, (SEQ ID NO: 477) | FWAVTAENEPSAG, (SEQ ID NO: 478) | WAVTAENEPSAGL, (SEQ ID NO: 479) |
| VTAENEPSAGLLS, (SEQ ID NO: 480) | PSAGLLSGYPFQC, (SEQ ID NO: 481) | AGLLSGYPFQCLG, (SEQ ID NO: 482) | GLLSGYPFQCLGF, (SEQ ID NO: 483) | SGYPFQCLGFTPE, (SEQ ID NO: 484) |
| YPFQCLGFTPEHQ, (SEQ ID NO: 485) | QCLGFTPEHQRDF, (SEQ ID NO: 486) | LGFTPEHQRDFIA, (SEQ ID NO: 487) | FTPEHQRDFIARD, (SEQ ID NO: 488) | RDFIARDLGPTLA, (SEQ ID NO: 489) |
| DFIARDLGPTLAN, (SEQ ID NO: 490) | RDLGPTLANSTHH, (SEQ ID NO: 491) | LGPTLANSTHHNV, (SEQ ID NO: 492) | PTLANSTHHNVRL, (SEQ ID NO: 493) | HNVRLLMLDDQRL, (SEQ ID NO: 494) |
| VRLLMLDDQRLLL, (SEQ ID NO: 495) | RLLMLDDQRLLLP, (SEQ ID NO: 496) | LLMLDDQRLLLPH, (SEQ ID NO: 497) | LMLDDQRLLLPHW, (SEQ ID NO: 498) | DDQRLLLPHWAKV, (SEQ ID NO: 499) |
| DQRLLLPHWAKVV, (SEQ ID NO: 500) | QRLLLPHWAKVVL, (SEQ ID NO: 501) | RLLLPHWAKVVLT, (SEQ ID NO: 502) | LLLPHWAKVVLTD, (SEQ ID NO: 503) | PHWAKVVLTDPEA, (SEQ ID NO: 504) |

TABLE 15-continued

| | | | | |
|---|---|---|---|---|
| WAKVVLTDPEAAK, (SEQ ID NO: 505) | AKVVLTDPEAAKY, (SEQ ID NO: 506) | KVVLTDPEAAKYV, (SEQ ID NO: 507) | VVLTDPEAAKYVH, (SEQ ID NO: 508) | EAAKYVHGIAVHW, (SEQ ID NO: 509) |
| AKYVHGIAVHWYL, (SEQ ID NO: 510) | KYVHGIAVHWYLD, (SEQ ID NO: 511) | YVHGIAVHWYLDF, (SEQ ID NO: 512) | HGIAVHWYLDFLA, (SEQ ID NO: 513) | IAVHWYLDFLAPA, (SEQ ID NO: 514) |
| VHWYLDFLAPAKA, (SEQ ID NO: 515) | HWYLDFLAPAKAT, (SEQ ID NO: 516) | WYLDFLAPAKATL, (SEQ ID NO: 517) | LDFLAPAKATLGE, (SEQ ID NO: 518) | DFLAPAKATLGET, (SEQ ID NO: 519) |
| AKATLGETHRLFP, (SEQ ID NO: 520) | ATLGETHRLFPNT, (SEQ ID NO: 521) | GETHRLFPNTMLF, (SEQ ID NO: 522) | ETHRLFPNTMLFA, (SEQ ID NO: 523) | THRLFPNTMLFAS, (SEQ ID NO: 524) |
| HRLFPNTMLFASE, (SEQ ID NO: 525) | RLFPNTMLFASEA, (SEQ ID NO: 526) | FPNTMLFASEACV, (SEQ ID NO: 527) | NTMLFASEACVGS, (SEQ ID NO: 528) | TMLFASEACVGSK, (SEQ ID NO: 529) |
| MLFASEACVGSKF, (SEQ ID NO: 530) | ACVGSKFWEQSVR, (SEQ ID NO: 531) | GSKFWEQSVRLGS, (SEQ ID NO: 532) | SKFWEQSVRLGSW, (SEQ ID NO: 533) | KFWEQSVRLGSWD, (SEQ ID NO: 534) |
| QSVRLGSWDRGMQ, (SEQ ID NO: 535) | VRLGSWDRGMQYS, (SEQ ID NO: 536) | RLGSWDRGMQYSH, (SEQ ID NO: 537) | GSWDRGMQYSHSI, (SEQ ID NO: 538) | WDRGMQYSHSIIT, (SEQ ID NO: 539) |
| RGMQYSHSIITNL, (SEQ ID NO: 540) | MQYSHSIITNLLY, (SEQ ID NO: 541) | QYSHSIITNLLYH, (SEQ ID NO: 542) | YSHSIITNLLYHV, (SEQ ID NO: 543) | HSIITNLLYHVVG, (SEQ ID NO: 544) |
| SIITNLLYHVVGW, (SEQ ID NO: 545) | TNLLYHVVGWTDW, (SEQ ID NO: 546) | NLLYHVVGWTDWN, (SEQ ID NO: 547) | LLYHVVGWTDWNL, (SEQ ID NO: 548) | YHVVGWTDWNLAL, (SEQ ID NO: 549) |
| HVVGWTDWNLALN, (SEQ ID NO: 550) | VVGWTDWNLALNP, (SEQ ID NO: 551) | VGWTDWNLALNPE, (SEQ ID NO: 552) | TDWNLALNPEGGP, (SEQ ID NO: 553) | WNLALNPEGGPNW, (SEQ ID NO: 554) |
| LALNPEGGPNWVR, (SEQ ID NO: 555) | PNWVRNFVDSPII, (SEQ ID NO: 556) | NWVRNFVDSPIIV, (SEQ ID NO: 557) | RNFVDSPIIVDIT, (SEQ ID NO: 558) | NFVDSPIIVDITK, (SEQ ID NO: 559) |
| SPIIVDITKDTFY, (SEQ ID NO: 560) | PIIVDITKDTFYK, (SEQ ID NO: 561) | IIVDITKDTFYKQ, (SEQ ID NO: 562) | VDITKDTFYKQPM, (SEQ ID NO: 563) | DTFYKQPMFYHLG, (SEQ ID NO: 564) |
| TFYKQPMFYHLGH, (SEQ ID NO: 565) | QPMFYHLGHFSKF, (SEQ ID NO: 566) | PMFYHLGHFSKFI, (SEQ ID NO: 567) | MFYHLGHFSKFIP, (SEQ ID NO: 568) | YHLGHFSKFIPEG, (SEQ ID NO: 569) |
| GHFSKFIPEGSQR, (SEQ ID NO: 570) | SKFIPEGSQRVGL, (SEQ ID NO: 571) | KFIPEGSQRVGLV, (SEQ ID NO: 572) | IPEGSQRVGLVAS, (SEQ ID NO: 573) | QRVGLVASQKNDL, (SEQ ID NO: 574) |
| VGLVASQKNDLDA, (SEQ ID NO: 575) | GLVASQKNDLDAV, (SEQ ID NO: 576) | SQKNDLDAVALMH, (SEQ ID NO: 577) | NDLDAVALMHPDG, (SEQ ID NO: 578) | DAVALMHPDGSAV, (SEQ ID NO: 579) |
| VALMHPDGSAVVV, (SEQ ID NO: 580) | ALMHPDGSAVVVV, (SEQ ID NO: 581) | SAVVVVLNRSSKD, (SEQ ID NO: 582) | AVVVVLNRSSKDV, (SEQ ID NO: 583) | VVVVLNRSSKDVP, (SEQ ID NO: 584) |
| VVVLNRSSKDVPL, (SEQ ID NO: 585) | VVLNRSSKDVPLT, (SEQ ID NO: 586) | KDVPLTIKDPAVG, (SEQ ID NO: 587) | VPLTIKDPAVGPL, (SEQ ID NO: 588) | PLTIKDPAVGFLE, (SEQ ID NO: 589) |
| LTIKDPAVGFLET, (SEQ ID NO: 590) | PAVGFLETISPGY, (SEQ ID NO: 591) | VGFLETISPGYSI, (SEQ ID NO: 592) | GFLETISPGYSIH, (SEQ ID NO: 593) | FLETISPGYSIHT, (SEQ ID NO: 594) |
| ETISPGYSIHTYL, (SEQ ID NO: 595) | PGYSIHTYLWHRQ, (SEQ ID NO: 596) | PGYSIHTYLWRRQ. (SEQ ID NO: 597) | | |

EXAMPLE 13

(Protein C)

Protein C is a vitamin K dependent serine-protease involved in the regulation of blood coagulation. The protein is activated by thrombin to produce activated protein C which in turn degrades (down regulates) Factors Va and VIIIa in the coagulation cascade. Protein C is expressed in the liver as a single chain precursor and undergoes a series of processing events resulting in a molecule comprising a light chain and a heavy chain held together by di-sulphide linkage. Protein C is activated by cleavage of a tetradecapeptide from the N-terminus of the heavy chain by thrombin. Pharmaceutical preparations of protein C in native or activated form, have value in the treatment of patients with vascular disorders and or acquired deficiencies in protein C. Such patients include therefore individuals suffering from thrombotic stroke, or protein C deficiency associated with sepsis, transplantation procedures, pregnancy, severe bums, major surgery or other severe traumas.

Protein C is also used in the treatment of individuals with hereditary protein C deficiency. This disclosure specifically pertains the human protein C being the mature (processed) form comprising a light chain of 155 amino acid residues and a heavy chain of 262 amino acid residues [Foster, D. C. et al (1985) *Proc. Natl. Acad. Sci. U.S.A.* 82: 4673-4677; Beckman, R. J. et al (1985) *Nucleic Acids Res.* 13: 5233-5247]. Others have provided protein C molecules including activated protein C formulations and methods of use [U.S. Pat. Nos. 6,159,468; 6,156,734; 6,037,322; 5,618,714].

Peptide sequences in human protein C heavy-chain with potential human MHC class II binding activity are shown in Table 16.

TABLE 16

| | | | | |
|---|---|---|---|---|
| DQEDQVDPRLIDG, (SEQ ID NO: 598) | QEDQVDPRLIDGK, (SEQ ID NO: 599) | DQVDPRLIDGKMT, (SEQ ID NO: 600) | QVDPRLIDGKMTR, (SEQ ID NO: 601) | VDPRLIDGKMTRR, (SEQ ID NO: 602) |
| DPRLIDGKMTRRG, (SEQ ID NO: 603) | PRLIDGKMTRRGD, (SEQ ID NO: 604) | RLIDGKMTRRGDS, (SEQ ID NO: 605) | SPWQVVLLDSKKK, (SEQ ID NO: 606) | WQVVLLDSKKKLA, (SEQ ID NO: 607) |
| QVVLLDSKKKLAC, (SEQ ID NO: 608) | VVLLDSKKKLACG, (SEQ ID NO: 609) | VLLDSKKKLACGA, (SEQ ID NO: 610) | DSKKKLACGAVLI, (SEQ ID NO: 611) | SKKKLACGAVLIH, (SEQ ID NO: 612) |
| KKLACGAVLIHPS, (SEQ ID NO: 613) | CGAVLIHPSWVLT, (SEQ ID NO: 614) | GAVLIHPSWVLTA, (SEQ ID NO: 615) | VLIHPSWVLTAAH, (SEQ ID NO: 616) | PSWVLTAAHCMDE, (SEQ ID NO: 617) |
| SWVLTAAHCMDES, (SEQ ID NO: 618) | WVLTAAHCMDESK, (SEQ ID NO: 619) | AAHCMDESKKLLV, (SEQ ID NO: 620) | HCMDESKKLLVRL, (SEQ ID NO: 621) | SKKLLVRLGEYDL, (SEQ ID NO: 622) |
| KKLLVRLGEYDLR, (SEQ ID NO: 623) | KLLVRLGEYDLRR, (SEQ ID NO: 624) | LLVRLGEYDLRRW, (SEQ ID NO: 625) | VRLGEYDLRRWEK, (SEQ ID NO: 626) | RLGEYDLRRWEKW, (SEQ ID NO: 627) |
| LGEYDLRRWEKWE, (SEQ ID NO: 628) | GEYDLRRWEKWEL, (SEQ ID NO: 629) | YDLRRWEKWELDL, (SEQ ID NO: 630) | RRWEKWELDLDIK, (SEQ ID NO: 631) | EKWELDLDIKEVF, (SEQ ID NO: 632) |
| WELDLDIKEVFVH, (SEQ ID NO: 633) | LDLDIKEVFVHPN, (SEQ ID NO: 634) | LDIKEVFVHPNYS, (SEQ ID NO: 635) | IKEVFVHPNYSKS, (SEQ ID NO: 636) | KEVFVHPNYSKST, (SEQ ID NO: 637) |
| EVFVHPNYSKSTT, (SEQ ID NO: 638) | VFVHPNYSKSTTD, (SEQ ID NO: 639) | PNYSKSTTDNDIA, (SEQ ID NO: 640) | SKSTTDNDIALLH, (SEQ ID NO: 641) | TTDNDIALLHLAQ, (SEQ ID NO: 642) |
| TDNDIALLHLAQP, (SEQ ID NO: 643) | DNDIALLHLAQPA, (SEQ ID NO: 644) | NDIALLHLAQPAT, (SEQ ID NO: 645) | IALLHLAQPATLS, (SEQ ID NO: 646) | ALLHLAQPATLSQ, (SEQ ID NO: 647) |
| LHLAQPATLSQTI, (SEQ ID NO: 648) | AQPATLSQTIVPI, (SEQ ID NO: 649) | PATLSQTIVPICL, (SEQ ID NO: 650) | ATLSQTIVPICLP, (SEQ ID NO: 651) | TLSQTIVPICLPD, (SEQ ID NO: 652) |
| QTIVPICLPDSGL, (SEQ ID NO: 653) | TIVPICLPDSGLA, (SEQ ID NO: 654) | IVPICLPDSGLAE, (SEQ ID NO: 655) | VPICLPDSGLAER, (SEQ ID NO: 656) | ICLPDSGLAEREL, (SEQ ID NO: 657) |
| PDSGLAERELNQA, (SEQ ID NO: 658) | SGLAERELNQAGQ, (SEQ ID NO: 659) | GLAERELNQAGQE, (SEQ ID NO: 660) | LAERELNQAGQET, (SEQ ID NO: 661) | RELNQAGQETLVT, (SEQ ID NO: 662) |
| GQETLVTGWYHS, (SEQ ID NO: 663) | ETLVTGWYHSSR, (SEQ ID NO: 664) | TLVTGWYHSSRE, (SEQ ID NO: 665) | TGWGYHSSREKEA, (SEQ ID NO: 666) | WGYHSSREKEAKR, (SEQ ID NO: 667) |
| WGYHSSREKEAKR, (SEQ ID NO: 668) | SREKEAKRNRTFV, (SEQ ID NO: 669) | RNRTFVLNFIKIP, (SEQ ID NO: 670) | NRTFVLNFIKIPV, (SEQ ID NO: 671) | RTFVLNFIKIPVV, (SEQ ID NO: 672) |
| TFVLNFIKIPVVP, (SEQ ID NO: 673) | FVLNFIKIPVVPH, (SEQ ID NO: 674) | LNFIKIPVVPHNE, (SEQ ID NO: 675) | NFIKIPVVPHNEC, (SEQ ID NO: 676) | IKIPVVPHNECSE, (SEQ ID NO: 677) |
| IPVVPHNECSEVM, (SEQ ID NO: 678) | PVVPHNECSEVMS, (SEQ ID NO: 679) | VVPHNECSEVMSN, (SEQ ID NO: 680) | NECSEVMSNMVSE, (SEQ ID NO: 681) | SEVMSNMVSENML, (SEQ ID NO: 682) |
| EVMSNMVSENMLC, (SEQ ID NO: 683) | VMSNMVSENMLCA, (SEQ ID NO: 684) | SNMVSENMLCAGI, (SEQ ID NO: 685) | MVSENMLCAGILG, (SEQ ID NO: 686) | VSENMLCAGILGD, (SEQ ID NO: 687) |
| ENMLCAGILGDRQ, (SEQ ID NO: 688) | NMLCAGILGDRQD, (SEQ ID NO: 689) | AGILGDRQDACEG, (SEQ ID NO: 690) | GILGDRQDACEGD, (SEQ ID NO: 691) | GPMVASFHGTWFL, (SEQ ID NO: 692) |
| PMVASFHGTWFLV, (SEQ ID NO: 693) | MVASFHGTWFLVG, (SEQ ID NO: 694) | ASFHGTWFLVGLV, (SEQ ID NO: 695) | GTWFLVGLVSWGE, (SEQ ID NO: 696) | TWFLVGLVSWGEG, (SEQ ID NO: 697) |
| WFLVGLVSWGEGC, (SEQ ID NO: 698) | FLVGLVSWGEGCG, (SEQ ID NO: 699) | VGLVSWGEGCGLL, (SEQ ID NO: 700) | GLVSWGEGCGLLH, (SEQ ID NO: 701) | VSWGEGCGLLHNY, (SEQ ID NO: 702) |
| EGCGLLHNYGVYT, (SEQ ID NO: 703) | CGLLHNYGVYTKV, (SEQ ID NO: 704) | GLLHNYGVYTKVS, (SEQ ID NO: 705) | LHNYGVYTKVSRY, (SEQ ID NO: 706) | HNYGVYTKVSRYL, (SEQ ID NO: 707) |
| YGVYTKVSRYLDW, (SEQ ID NO: 708) | GVYTKVSRYLDWI, (SEQ ID NO: 709) | TKVSRYLDWIHGH, (SEQ ID NO: 710) | SRYLDWIHGHIRD, (SEQ ID NO: 711) | RYLDWIHGHIRDK, (SEQ ID NO: 712) |
| LDWIHGHIRDKEA, (SEQ ID NO: 713) | DWIHGHIRDKEAP, (SEQ ID NO: 714) | HGHIRDKEAPQKS, (SEQ ID NO: 715) | GHIRDKEAPQKSW. (SEQ ID NO: 716) | |

Peptide sequences in human protein C light-chain with potential human MHC class II binding activity are shown in Table 17.

TABLE 17

| | | | | |
|---|---|---|---|---|
| NSFLEELRHSSLE, (SEQ ID NO: 717) | SFLEELRHSSLER, (SEQ ID NO: 718) | EELRHSSLERECI, (SEQ ID NO: 719) | LRHSSLERECIEE, (SEQ ID NO: 720) | SSLERECIEEICD, (SEQ ID NO: 721) |
| ECIEEICDFEEAK, (SEQ ID NO: 722) | IEEICDFEEAKEI, (SEQ ID NO: 723) | EEICDFEEAKEIF, (SEQ ID NO: 724) | EICDFEEAKEIFQ, (SEQ ID NO: 725) | CDFEEAKEIFQNV, (SEQ ID NO: 726) |
| KEIFQNVDDTLAF, (SEQ ID NO: 727) | EIFQNVDDTLAFW, (SEQ ID NO: 728) | IFQNVDDTLAFWS, (SEQ ID NO: 729) | QNVDDTLAFWSKH, (SEQ ID NO: 730) | DDTLAFWSKHVDG, (SEQ ID NO: 731) |
| DTLAFWSKHVDGD, (SEQ ID NO: 732) | LAFWSKHVDGDQC, (SEQ ID NO: 733) | AFWSKHVDGDQCL, (SEQ ID NO: 734) | WSKHVDGDQCLVL, (SEQ ID NO: 735) | KHVDGDQCLVLPL, (SEQ ID NO: 736) |
| QCLVLPLEHPCAS, (SEQ ID NO: 737) | CLVLPLEHPCASL, (SEQ ID NO: 738) | LVLPLEHPCASLC, (SEQ ID NO: 739) | LPLEHPCASLCCG, (SEQ ID NO: 740) | ASLCCGHGTCIDG, (SEQ ID NO: 741) |
| HGTCIDGIGSFSC, (SEQ ID NO: 742) | TCIDGIGSFSCDC, (SEQ ID NO: 743) | DGIGSFSCDCRSG, (SEQ ID NO: 744) | GSFSCDCRSGWEG, (SEQ ID NO: 745) | CRSGWEGRFCQRE, (SEQ ID NO: 746) |
| SGWEGRFCQREVS, (SEQ ID NO: 747) | GWEGRFCQREVSF, (SEQ ID NO: 748) | GRFCQREVSFLNC, (SEQ ID NO: 749) | RFCQREVSFLNCS, (SEQ ID NO: 750) | QREVSFLNCSLDN, (SEQ ID NO: 751) |
| REVSFLNCSLDNG, (SEQ ID NO: 752) | VSFLNCSLDNGGC, (SEQ ID NO: 753) | SFLNCSLDNGGCT, (SEQ ID NO: 754) | CSLDNGGCTHYCL, (SEQ ID NO: 755) | THYCLEEVGWRRC, (SEQ ID NO: 756) |
| YCLEEVGWRRCSC, (SEQ ID NO: 757) | EEVGWRRCSCAPG, (SEQ ID NO: 758) | VGWRRCSCAPGYK, (SEQ ID NO: 759) | RRCSCAPGYKLGD, (SEQ ID NO: 760) | APGYKLGDDLLQC, (SEQ ID NO: 761) |
| PGYKLGDDLLQCH, (SEQ ID NO: 762) | YKLGDDLLQCHPA, (SEQ ID NO: 763) | LGDDLLQCHPAVK, (SEQ ID NO: 764) | GDDLLQCHPAVKF, (SEQ ID NO: 765) | DDLLQCHPAVKFP, (SEQ ID NO: 766) |
| DLLQCHPAVKFPC, (SEQ ID NO: 767) | PAVKFPCGRPWKR, (SEQ ID NO: 768) | VKFPCGRPWKRME, (SEQ ID NO: 769) | RPWKRMEKKRSHL. (SEQ ID NO: 770) | |

EXAMPLE 14

(Subtilisins)

The subtilisins are a class of protease enzyme with significant economic and industrial importance. They may be used as components of detergents or cosmetics, or in the 35 production of textiles and other industries and consumer preparations. Exposure of particular human subjects to bacterial subtilisins may evoke an unwanted hypersensitivity reaction in those individuals. There is a need for subtilisin analogues with enhanced properties and especially, improvements in the biological properties of the protein. In this regard, it is highly desired to provide subtilisins with reduced or absent potential to induce an immune response in the human subject. Subtilisin proteins such as identified from other sources including bacterial, fungal or vertebrate sources, including mammalian organisms and man, have in common many of the peptide sequences of the present disclosure and have in common many peptide sequences with substantially the same sequence as those of the disclosed listing. Such protein sequences equally therefore fall under the scope of the present invention. Others have provided subtilisin molecules including modified subtilisins [U.S. Pat. Nos. 5,700,676; 4,914,031; 5,397,705; 5,972,682].

Peptide sequences in *B. lentus* subtilisin with potential human MHC class II binding activity are shown in Table 18.

TABLE 18

| | | | |
|---|---|---|---|
| QSVPWGISRVQAP, (SEQ ID NO: 771) | SVPWGISRVQAPA, (SEQ ID NO: 772) | WGISRVQAPAAHN, (SEQ ID NO: 773) | SRVQAPAAHNRGL, (SEQ ID NO: 774) |
| VQAPAAHNRGLTG, (SEQ ID NO: 775) | AHNRGLTGSGVKV, (SEQ ID NO: 776) | RGLTGSGVKVAVL, (SEQ ID NO: 777) | SGVKVAVLDTGIS, (SEQ ID NO: 778) |
| GVKVAVLDTGIST, (SEQ ID NO: 779) | VKVAVLDTGISTH, (SEQ ID NO: 780) | VAVLDTGISTHPD, (SEQ ID NO: 781) | AVLDTGISTHPDL, (SEQ ID NO: 782) |
| TGISTHPDLNIRG, (SEQ ID NO: 783) | ISTHPDLNIRGGA, (SEQ ID NO: 784) | HPDLNIRGGASFV, (SEQ ID NO: 785) | PDLNIRGGASFVP, (SEQ ID NO: 786) |
| LNIRGGASFVPGE, (SEQ ID NO: 787) | ASFVPGEPSTQDG, (SEQ ID NO: 788) | SFVPGEPSTQDGN, (SEQ ID NO: 789) | EPSTQDGNGHGTH, (SEQ ID NO: 790) |
| GHGTHVAGTIAAL, (SEQ ID NO: 791) | HGTHVAGTIAALN, (SEQ ID NO: 792) | THVAGTIAALNNS, (SEQ ID NO: 793) | AGTIAALNNSIGV, (SEQ ID NO: 794) |

TABLE 18-continued

| | | | |
|---|---|---|---|
| GTIAALNNSIGVL, (SEQ ID NO: 795) | AALNNSIGVLGVA, (SEQ ID NO: 796) | ALNNSIGVLGVAP, (SEQ ID NO: 797) | NSIGVLGVAPSAE, (SEQ ID NO: 798) |
| GVLGVAPSAELYA, (SEQ ID NO: 799) | LGVAPSAELYAVK, (SEQ ID NO: 800) | APSAELYAVKVLG, (SEQ ID NO: 801) | AELYAVKVLGASG, (SEQ ID NO: 802) |
| ELYAVKVLGASGS, (SEQ ID NO: 803) | YAVKVLGASGSGS, (SEQ ID NO: 804) | VKVLGASGSGSVS, (SEQ ID NO: 805) | KVLGASGSGSVSS, (SEQ ID NO: 806) |
| SGSGSVSSIAQGL, (SEQ ID NO: 807) | SGSVSSIAQGLEW, (SEQ ID NO: 808) | GSVSSIAQGLEWA, (SEQ ID NO: 809) | SSIAQGLEWAGNN, (SEQ ID NO: 810) |
| QGLEWAGNNGMHV, (SEQ ID NO: 811) | LEWAGNNGMHVAN, (SEQ ID NO: 812) | NNGMHVANLSLGS, (SEQ ID NO: 813) | NGMHVANLSLGSP, (SEQ ID NO: 814) |
| MHVANLSLGSPSP, (SEQ ID NO: 815) | HVANLSLGSPSPS, (SEQ ID NO: 816) | VANLSLGSPSPSA, (SEQ ID NO: 817) | ANLSLGSPSPSAT, (SEQ ID NO: 818) |
| LSLGSPSPSATLE, (SEQ ID NO: 819) | SPSPSATLEQAVN, (SEQ ID NO: 820) | SPSATLEQAVNSA, (SEQ ID NO: 821) | PSATLEQAVNSAT, (SEQ ID NO: 822) |
| ATLEQAVNSATSR, (SEQ ID NO: 823) | TLEQAVNSATSRG, (SEQ ID NO: 824) | QAVNSATSRGVLV, (SEQ ID NO: 825) | RGVLVVAASGNSG, (SEQ ID NO: 826) |
| GVLVVAASGNSGA, (SEQ ID NO: 827) | VLVVAASGNSGAG, (SEQ ID NO: 828) | LVVAASGNSGAGS, (SEQ ID NO: 829) | VAASGNSGAGSIS, (SEQ ID NO: 830) |
| GSISYPARYANAM, (SEQ ID NO: 831) | ISYPARYANAMAV, (SEQ ID NO: 832) | YPARYANAMAVGA, (SEQ ID NO: 833) | ARYANAMAVGATD, (SEQ ID NO: 834) |
| NAMAVGATDQNNN, (SEQ ID NO: 835) | MAVGATDQNNNRA, (SEQ ID NO: 836) | AVGATDQNNNRAS, (SEQ ID NO: 837) | NNRASFSQYGAGL, (SEQ ID NO: 838) |
| RASFSQYGAGLDI, (SEQ ID NO: 839) | ASFSQYGAGLDIV, (SEQ ID NO: 840) | SQYGAGLDIVAPG, (SEQ ID NO: 841) | GAGLDIVAPGVNV, (SEQ ID NO: 842) |
| AGLDIVAPGVNVQ, (SEQ ID NO: 843) | LDIVAPGVNVQST, (SEQ ID NO: 844) | DIVAPGVNVQSTY, (SEQ ID NO: 845) | APGVNVQSTYPGS, (SEQ ID NO: 846) |
| PGVNVQSTYPGST, (SEQ ID NO: 847) | VNVQSTYPGSTYA, (SEQ ID NO: 848) | STYPGSTYASLNG, (SEQ ID NO: 849) | STYASLNGTSMAT, (SEQ ID NO: 850) |
| ASLNGTSMATPHV, (SEQ ID NO: 851) | NGTSMATPHVAGA, (SEQ ID NO: 852) | MATPHVAGAAALV, (SEQ ID NO: 853) | TSMATPHVAGAAA, (SEQ ID NO: 854) |
| PHVAGAAALVKQK, (SEQ ID NO: 855) | AALVKQKNPSWSN, (SEQ ID NO: 856) | ALVKQKNPSWSNV, (SEQ ID NO: 857) | PSWSNVQIRNHLK, (SEQ ID NO: 858) |
| WSNVQIRNHLKNT, (SEQ ID NO: 859) | SNVQIRNHLKNTA, (SEQ ID NO: 860) | VQIRNHLKNTATS, (SEQ ID NO: 861) | QIRNHLKNTATSL, (SEQ ID NO: 862) |
| RNHLKNTATSLGS, (SEQ ID NO: 863) | NHLKNTATSLGST, (SEQ ID NO: 864) | HLKNTATSLGSTN, (SEQ ID NO: 865) | ATSLGSTNLYGSG, (SEQ ID NO: 866) |
| TSLGSTNLYGSGL, (SEQ ID NO: 867) | LGSTNLYGSGLVN, (SEQ ID NO: 868) | TNLYGSGLVNAEA, (SEQ ID NO: 869) | NLYGSGLVNAEAA, (SEQ ID NO: 870) |
| LYGSGLVNAEAAT. (SEQ ID NO: 871) | | | |

Peptide sequences in *B. amyloliquefaciens* subtilisin with potential human MHC class II binding activity are shown in Table 19.

TABLE 19

| | | | |
|---|---|---|---|
| QSVPYGVSQIKAP, (SEQ ID NO: 872) | SVPYGVSQIKAPA, (SEQ ID NO: 873) | VPYGVSQIKAPAL, (SEQ ID NO: 874) | YGVSQIKAPALHS, (SEQ ID NO: 875) |
| VSQIKAPALHSQG, (SEQ ID NO: 876) | SQIKAPALHSQGY, (SEQ ID NO: 877) | PALHSQGYTGSNV, (SEQ ID NO: 878) | QGYTGSNVKVAVI, (SEQ ID NO: 879) |
| SNVKVAVIDSGID, (SEQ ID NO: 880) | VKVAVIDSGIDSS, (SEQ ID NO: 881) | KVAVIDSGIDSSH, (SEQ ID NO: 882) | VAVIDSGIDSSHP, (SEQ ID NO: 883) |

TABLE 19-continued

AVIDSGIDSSHPD, VIDSGIDSSHPDL, SGIDSSHPDLKVA, DSSHPDLKVAGGA,
(SEQ ID NO: 884) (SEQ ID NO: 885) (SEQ ID NO: 886) (SEQ ID NO: 887)

SHPDLKVAGGASM, HPDLKVAGGASMV, PDLKVAGGASMVP, DLKVAGGASMVPS,
(SEQ ID NO: 888) (SEQ ID NO: 889) (SEQ ID NO: 890) (SEQ ID NO: 891)

LKVAGGASMVPSE, GGASMVPSETNPF, ASMVPSETNPFQD, SMVPSETNPFQDN,
(SEQ ID NO: 892) (SEQ ID NO: 893) (SEQ ID NO: 894) (SEQ ID NO: 895)

NPFQDNNSHGTHV, FQDNNSHGTHVAG, SHGTHVAGTVAAL, HGTHVAGTVAALN,
(SEQ ID NO: 896) (SEQ ID NO: 897) (SEQ ID NO: 898) (SEQ ID NO: 899)

THVAGTVAALNNS, AGTVAALNNSIGV, GTVAALNNSIGVL, AALNNSIGVLGVA,
(SEQ ID NO: 900) (SEQ ID NO: 901) (SEQ ID NO: 902) (SEQ ID NO: 903)

ALNNSIGVLGVAP, NNSIGVLGVAPSA, NSIGVLGVAPSAS, SIGVLGVAPSASL,
(SEQ ID NO: 904) (SEQ ID NO: 905) (SEQ ID NO: 906) (SEQ ID NO: 907)

IGVLGVAPSASLY, GVLGVAPSASLYA, LGVAPSASLYAVK, APSASLYAVKVLG,
(SEQ ID NO: 908) (SEQ ID NO: 909) (SEQ ID NO: 910) (SEQ ID NO: 911)

ASLYAVKVLGADG, SLYAVKVLGADGS, YAVKVLGADGSGQ, VKVLGADGSGQYS,
(SEQ ID NO: 912) (SEQ ID NO: 913) (SEQ ID NO: 914) (SEQ ID NO: 915)

KVLGADGSGQYSW, ADGSGQYSWIING, GQYSWIINGIEWA, YSWIINGIEWAIA,
(SEQ ID NO: 916) (SEQ ID NO: 917) (SEQ ID NO: 918) (SEQ ID NO: 919)

SWIINGIEWAIAN, WIINGIEWAIANN, NGIEWAIANNMDV, IEWAIANNMDVIN,
(SEQ ID NO: 920) (SEQ ID NO: 921) (SEQ ID NO: 922) (SEQ ID NO: 923)

WAIANNMDVINMS, ANNMDVINMSLGG, NNMDVINMSLGGP, MDVINMSLGGPSG,
(SEQ ID NO: 924) (SEQ ID NO: 925) (SEQ ID NO: 926) (SEQ ID NO: 927)

DVINMSLGGPSGS, INMSLGGPSGSAA, MSLGGPSGSAALK, AALKAAVDKAVAS,
(SEQ ID NO: 928) (SEQ ID NO: 929) (SEQ ID NO: 930) (SEQ ID NO: 931)

ALKAAVDKAVASG, AAVDKAVASGVVV, AVDKAVASGVVVV, KAVASGVVVVAAA,
(SEQ ID NO: 932) (SEQ ID NO: 933) (SEQ ID NO: 934) (SEQ ID NO: 935)

SGVVVVAAAGNEG, GVVVVAAAGNEGT, VVVVAAAGNEGTS, VVVAAAGNEGTSG,
(SEQ ID NO: 936) (SEQ ID NO: 937) (SEQ ID NO: 938) (SEQ ID NO: 939)

AAAGNEGTSGSSS, SSTVGYPGKYPSV, STVGYPGKYPSVI, VGYPGKYPSVIAV,
(SEQ ID NO: 940) (SEQ ID NO: 941) (SEQ ID NO: 942) (SEQ ID NO: 943)

GKYPSVIAVGAVD, PSVIAVGAVDSSN, SVIAVGAVDSSNQ, IAVGAVDSSNQRA,
(SEQ ID NO: 944) (SEQ ID NO: 945) (SEQ ID NO: 946) (SEQ ID NO: 947)

GAVDSSNQRASFS, VDSSNQRASFSSV, ASFSSVGPELDVM, SSVGPELDVMAPG,
(SEQ ID NO: 948) (SEQ ID NO: 949) (SEQ ID NO: 950) (SEQ ID NO: 951)

GPELDVMAPGVSI, PELDVMAPGVSIQ, ELDVMAPGVSIQS, LDVMAPGVSIQST,
(SEQ ID NO: 952) (SEQ ID NO: 953) (SEQ ID NO: 954) (SEQ ID NO: 955)

DVMAPGVSIQSTL, APGVSIQSTLPGN, PGVSIQSTLPGNK, VSIQSTLPGNKYG,
(SEQ ID NO: 956) (SEQ ID NO: 957) (SEQ ID NO: 958) (SEQ ID NO: 959)

STLPGNKYGAYNG, GNKYGAYNGTSMA, NKYGAYNGTSMAS, GAYNGTSMASPHV,
(SEQ ID NO: 960) (SEQ ID NO: 961) (SEQ ID NO: 962) (SEQ ID NO: 963)

YNGTSMASPHVAG, TSMASPHVAGAAA, MASPHVAGAAALI, PHVAGAAALILSK,
(SEQ ID NO: 964) (SEQ ID NO: 965) (SEQ ID NO: 966) (SEQ ID NO: 967)

AAALILSKHPNWT, AALILSKHPNWTN, ALILSKHPNWTNT, LILSKHPNWTNTQ,
(SEQ ID NO: 968) (SEQ ID NO: 969) (SEQ ID NO: 970) (SEQ ID NO: 971)

PNWTNTQVRSSLE, TQVRSSLENTTTK, QVRSSLENTTTKL, VRSSLENTTTKLG,
(SEQ ID NO: 972) (SEQ ID NO: 973) (SEQ ID NO: 974) (SEQ ID NO: 975)

SSLENTTTKLGDS, TKLGDSFYYGKGL, LGDSFYYGKGLIN, DSFYYGKGLINVQ,
(SEQ ID NO: 976) (SEQ ID NO: 977) (SEQ ID NO: 978) (SEQ ID NO: 979)

SFYYGKGLINVQA, FYYGKGLINVQAA, YYGKGLINVQAAA.
(SEQ ID NO: 980) (SEQ ID NO: 981) (SEQ ID NO: 982)

Peptide sequences in *B. subtilis* subtilisin with potential human MHC class II binding activity are shown in Table 20.

TABLE 20

| | | | |
|---|---|---|---|
| QSVPYGISQIKAP, (SEQ ID NO: 983) | SVPYGISQIKAPA, (SEQ ID NO: 984) | VPYGISQIKAPAL, (SEQ ID NO: 985) | YGISQIKAPALHS, (SEQ ID NO: 986) |
| ISQIKAPALHSQG, (SEQ ID NO: 987) | SQIKAPALHSQGY, (SEQ ID NO: 988) | PALHSQGYTGSNV, (SEQ ID NO: 989) | QGYTGSNVKVAVI, (SEQ ID NO: 990) |
| SNVKVAVIDSGID, (SEQ ID NO: 991) | VKVAVIDSGIDSS, (SEQ ID NO: 992) | KVAVIDSGIDSSH, (SEQ ID NO: 993) | VAVIDSGIDSSHP, (SEQ ID NO: 994) |
| AVIDSGIDSSHPD, (SEQ ID NO: 995) | VIDSGIDSSHPDL, (SEQ ID NO: 996) | SGIDSSHPDLNVR, (SEQ ID NO: 997) | DSSHPDLNVRGGA, (SEQ ID NO: 998) |
| HPDLNVRGGASFV, (SEQ ID NO: 999) | PDLNVRGGASFVP, (SEQ ID NO: 1000) | DLNVRGGASFVPS, (SEQ ID NO: 1001) | LNVRGGASFVPSE, (SEQ ID NO: 1002) |
| GGASFVPSETNPY, (SEQ ID NO: 1003) | ASFVPSETNPYQD, (SEQ ID NO: 1004) | SFVPSETNPYQDG, (SEQ ID NO: 1005) | NPYQDGGSHGTHV, (SEQ ID NO: 1006) |
| SHGTHVAGTIAAL, (SEQ ID NO: 1007) | HGTHVAGTIAALN, (SEQ ID NO: 1008) | THVAGTIAALNNS, (SEQ ID NO: 1009) | AGTIAALNNSIGV, (SEQ ID NO: 1010) |
| GTIAALNNSIGVL, (SEQ ID NO: 1011) | AALNNSIGVLGVS, (SEQ ID NO: 1012) | ALNNSIGVLGVSP, (SEQ ID NO: 1013) | NNSIGVLGVSPSA, (SEQ ID NO: 1014) |
| NSIGVLGVSPSAS, (SEQ ID NO: 1015) | IGVLGVSPSASLY, (SEQ ID NO: 1016) | GVLGVSPSASLYA, (SEQ ID NO: 1017) | LGVSPSASLYAVK, (SEQ ID NO: 1018) |
| SPSASLYAVKVLD, (SEQ ID NO: 1019) | ASLYAVKVLDSTG, (SEQ ID NO: 1020) | YAVKVLDSTGSGQ, (SEQ ID NO: 1021) | VKVLDSTGSGQYS, (SEQ ID NO: 1022) |
| KVLDSTGSGQYSW, (SEQ ID NO: 1023) | STGSGQYSWIING, (SEQ ID NO: 1024) | GQYSWIINGIEWA, (SEQ ID NO: 1025) | YSWIINGIEWAIS, (SEQ ID NO: 1026) |
| SWIINGIEWAISN, (SEQ ID NO: 1027) | WIINGIEWAISNN, (SEQ ID NO: 1028) | NGIEWAISNNMDV, (SEQ ID NO: 1029) | IEWAISNNMDVIN, (SEQ ID NO: 1030) |
| WAISNNMDVINMS, (SEQ ID NO: 1031) | SNNMDVINMSLGG, (SEQ ID NO: 1032) | NNMDVINMSLGGP, (SEQ ID NO: 1033) | MDVINMSLGGPTG, (SEQ ID NO: 1034) |
| DVINMSLGGPTGS, (SEQ ID NO: 1035) | INMSLGGPTGSTA, (SEQ ID NO: 1036) | MSLGGPTGSTALK, (SEQ ID NO: 1037) | TALKTVVDKAVSS, (SEQ ID NO: 1038) |
| ALKTVVDKAVSSG, (SEQ ID NO: 1039) | KTVVDKAVSSGIV, (SEQ ID NO: 1040) | TVVDKAVSSGIVV, (SEQ ID NO: 1041) | VVDKAVSSGIVVA, (SEQ ID NO: 1042) |
| KAVSSGIVVAAAA, (SEQ ID NO: 1043) | VSSGIVVAAAAGN, (SEQ ID NO: 1044) | SGIVVAAAAGNEG, (SEQ ID NO: 1045) | GIVVAAAAGNEGS, (SEQ ID NO: 1046) |
| IVVAAAAGNEGSS, (SEQ ID NO: 1047) | VVAAAAGNEGSSG, (SEQ ID NO: 1048) | AAAGNEGSSGSTS, (SEQ ID NO: 1049) | TSTVGYPAKYPST, (SEQ ID NO: 1050) |
| STVGYPAKYPSTI, (SEQ ID NO: 1051) | VGYPAKYPSTIAV, (SEQ ID NO: 1052) | AKYPSTIAVGAVN, (SEQ ID NO: 1053) | PSTIAVGAVNSSN, (SEQ ID NO: 1054) |
| STIAVGAVNSSNQ, (SEQ ID NO: 1055) | TIAVGAVNSSNQR, (SEQ ID NO: 1056) | IAVGAVNSSNQRA, (SEQ ID NO: 1057) | GAVNSSNQRASFS, (SEQ ID NO: 1058) |
| VNSSNQRASFSSA, (SEQ ID NO: 1059) | NQRASFSSAGSEL, (SEQ ID NO: 1060) | ASFSSAGSELDVM, (SEQ ID NO: 1061) | GSELDVMAPGVSI, (SEQ ID NO: 1062) |
| ELDVMAPGVSIQS, (SEQ ID NO: 1063) | SELDVMAPGVSIQ, (SEQ ID NO: 1064) | LDVMAPGVSIQST, (SEQ ID NO: 1065) | DVMAPGVSIQSTL, (SEQ ID NO: 1066) |

TABLE 20-continued

| | | | |
|---|---|---|---|
| APGVSIQSTLPGG, (SEQ ID NO: 1067) | PGVSIQSTLPGGT, (SEQ ID NO: 1068) | VSIQSTLPGGTYG, (SEQ ID NO: 1069) | STLPGGTYGAYNG, (SEQ ID NO: 1070) |
| GGTYGAYNGTSMA, (SEQ ID NO: 1071) | GTYGAYNGTSMAT, (SEQ ID NO: 1072) | GAYNGTSMATPHV, (SEQ ID NO: 1073) | YNGTSMATPHVAG, (SEQ ID NO: 1074) |
| TSMATPHVAGAAA, (SEQ ID NO: 1075) | MATPHVAGAAALI, (SEQ ID NO: 1076) | PHVAGAAALILSK, (SEQ ID NO: 1077) | GAAALILSKHPTW, (SEQ ID NO: 1078) |
| AALILSKHPTWTN, (SEQ ID NO: 1079) | ALILSKHPTWTNA, (SEQ ID NO: 1080) | LILSKHPTWTNAQ, (SEQ ID NO: 1081) | PTWTNAQVRDRLE, (SEQ ID NO: 1082) |
| AQVRDRLESTATY, (SEQ ID NO: 1083) | QVRDRLESTATYL, (SEQ ID NO: 1084) | DRLESTATYLGNS, (SEQ ID NO: 1085) | ATYLGNSFYYGKG, (SEQ ID NO: 1086) |
| TYLGNSFYYGKGL, (SEQ ID NO: 1087) | LGNSFYYGKGLIN, (SEQ ID NO: 1088) | NSFYYGKGLINVQ, (SEQ ID NO: 1089) | SFYYGKGLINVQA, (SEQ ID NO: 1090) |
| FYYGKGLINVQAA, (SEQ ID NO: 1091) | YYGKGLINVQAAA. (SEQ ID NO: 1092) | | |

Peptide sequences in *B. licheniformis* subtilisin with potential human MHC class II binding activity are shown in Table 21.

TABLE 21

| | | | |
|---|---|---|---|
| QTVPYGIPLIKAD, (SEQ ID NO: 1093) | VPYGIPLIKADKV, (SEQ ID NO: 1094) | YGIPLIKADKVQA, (SEQ ID NO: 1095) | IPLIKADKVQAQG, (SEQ ID NO: 1096) |
| PLIKADKVQAQGF, (SEQ ID NO: 1097) | IKADKVQAQGFKG, (SEQ ID NO: 1098) | DKVQAQGFKGANV, (SEQ ID NO: 1099) | QGFKGANVKVAVL, (SEQ ID NO: 1100) |
| ANVKVAVLDTGIQ, (SEQ ID NO: 1101) | VKVAVLDTGIQAS, (SEQ ID NO: 1102) | KVAVLDTGIQASH, (SEQ ID NO: 1103) | VAVLDTGIQASHP, (SEQ ID NO: 1104) |
| AVLDTGIQASHPD, (SEQ ID NO: 1105) | VLDTGIQASHPDL, (SEQ ID NO: 1106) | DTGIQASHPDLNV, (SEQ ID NO: 1107) | TGIQASHPDLNVV, (SEQ ID NO: 1108) |
| QASHPDLNVVGGA, (SEQ ID NO: 1109) | HPDLNVVGGASFV, (SEQ ID NO: 1110) | PDLNVVGGASFVA, (SEQ ID NO: 1111) | DLNVVGGASFVAG, (SEQ ID NO: 1112) |
| LNVVGGASFVAGE, (SEQ ID NO: 1113) | NVVGGASFVAGEA, (SEQ ID NO: 1114) | ASFVAGEAYNTDG, (SEQ ID NO: 1115) | SFVAGEAYNTDGN, (SEQ ID NO: 1116) |
| EAYNTDGNGHGTH, (SEQ ID NO: 1117) | GHGTHVAGTVAAL, (SEQ ID NO: 1118) | HGTHVAGTVAALD, (SEQ ID NO: 1119) | THVAGTVAALDNT, (SEQ ID NO: 1120) |
| GTVAALDNTTGVL, (SEQ ID NO: 1121) | TVAALDNTTGVLG, (SEQ ID NO: 1122) | AALDNTTGVLGVA, (SEQ ID NO: 1123) | DNTTGVLGVAPSV, (SEQ ID NO: 1124) |
| TTGVLGVAPSVSL, (SEQ ID NO: 1125) | TGVLGVAPSVSLY, (SEQ ID NO: 1126) | GVLGVAPSVSLYA, (SEQ ID NO: 1127) | LGVAPSVSLYAVK, (SEQ ID NO: 1128) |
| APSVSLYAVKVLN, (SEQ ID NO: 1129) | PSVSLYAVKVLNS, (SEQ ID NO: 1130) | VSLYAVKVLNSSG, (SEQ ID NO: 1131) | SLYAVKVLNSSGS, (SEQ ID NO: 1132) |
| YAVKVLNSSGSGS, (SEQ ID NO: 1133) | VKVLNSSGSGSYS, (SEQ ID NO: 1134) | KVLNSSGSGSYSG, (SEQ ID NO: 1135) | GSYSGIVSGIEWA, (SEQ ID NO: 1136) |

TABLE 21-continued

| | | | |
|---|---|---|---|
| TNGMDVINMSLGG, (SEQ ID NO: 1137) | NGMDVINMSLGGA, (SEQ ID NO: 1138) | MDVINMSLGGASG, (SEQ ID NO: 1139) | DVINMSLGGASGS, (SEQ ID NO: 1140) |
| INMSLGGASGSTA, (SEQ ID NO: 1141) | MSLGGASGSTAMK, (SEQ ID NO: 1142) | TAMKQAVDNAYAR, (SEQ ID NO: 1143) | AMKQAVDNAYARG, (SEQ ID NO: 1144) |
| QAVDNAYARGVVV, (SEQ ID NO: 1145) | NAYARGVVVVAAA, (SEQ ID NO: 1146) | RGVVVVAAAGNSG, (SEQ ID NO: 1147) | GVVVVAAAGNSGN, (SEQ ID NO: 1148) |
| VVVVAAAGNSGNS, (SEQ ID NO: 1149) | VVVAAAGNSGNSG, (SEQ ID NO: 1150) | NTIGYPAKYDSVI, (SEQ ID NO: 1151) | IGYPAKYDSVIAV, (SEQ ID NO: 1152) |
| AKYDSVIAVGAVD, (SEQ ID NO: 1153) | DSVIAVGAVDSNS, (SEQ ID NO: 1154) | SVIAVGAVDSNSN, (SEQ ID NO: 1155) | IAVGAVDSNSNRA, (SEQ ID NO: 1156) |
| AVGAVDSNSNRAS, (SEQ ID NO: 1157) | GAVDSNSNRASFS, (SEQ ID NO: 1158) | AVDSNSNRASFSS, (SEQ ID NO: 1159) | SNRASFSSVGAEL, (SEQ ID NO: 1160) |
| ASFSSVGAELEVM, (SEQ ID NO: 1161) | SSVGAELEVMAPG, (SEQ ID NO: 1162) | GAELEVMAPGAGV, (SEQ ID NO: 1163) | AELEVMAPGAGVY, (SEQ ID NO: 1164) |
| ELEVMAPGAGVYS, (SEQ ID NO: 1165) | LEVMAPGAGVYST, (SEQ ID NO: 1166) | EVMAPGAGVYSTY, (SEQ ID NO: 1167) | APGAGVYSTYPTN, (SEQ ID NO: 1168) |
| AGVYSTYPTNTYA, (SEQ ID NO: 1169) | GVYSTYPTNTYAT, (SEQ ID NO: 1170) | STYPTNTYATLNG, (SEQ ID NO: 1171) | NTYATLNGTSMAS, (SEQ ID NO: 1172) |
| ATLNGTSMASPHV, (SEQ ID NO: 1173) | LNGTSMASPHVAG, (SEQ ID NO: 1174) | TSMASPHVAGAAA, (SEQ ID NO: 1175) | MASPHVAGAAALI, (SEQ ID NO: 1176) |
| PHVAGAAALILSK, (SEQ ID NO: 1177) | GAAALILSKHPNL, (SEQ ID NO: 1178) | AALILSKHPNLSA, (SEQ ID NO: 1179) | ALILSKHPNLSAS, (SEQ ID NO: 1180) |
| LILSKHPNLSASQ, (SEQ ID NO: 1181) | SKHPNLSASQVRN, (SEQ ID NO: 1182) | HPNLSASQVRNRL, (SEQ ID NO: 1183) | PNLSASQVRNRLS, (SEQ ID NO: 1184) |
| LSASQVRNRLSST, (SEQ ID NO: 1185) | SQVRNRLSSTATY, (SEQ ID NO: 1186) | QVRNRLSSTATYL, (SEQ ID NO: 1187) | NRLSSTATYLGSS, (SEQ ID NO: 1188) |
| ATYLGSSFYYGKG, (SEQ ID NO: 1189) | TYLGSSFYYGKGL, (SEQ ID NO: 1190) | LGSSFYYGKGLIN, (SEQ ID NO: 1191) | SSFYYGKGLINVE, (SEQ ID NO: 1192) |
| SFYYGKGLINVEA, (SEQ ID NO: 1193) | FYYGKGLINVEAA, (SEQ ID NO: 1194) | YYGKGLINVEAAA. (SEQ ID NO: 1195) | |

EXAMPLE 15

(Ligands of CNTF)

The present invention provides for modified forms of the protein subunits comprising a heterodimeric ligand for the ciliary neurotrophic factor (CNTF) receptor complex in humans. The receptor complex is activated by at least two ligands including CNTF and a heterodimeric complex comprising cardiotrophin-like cytokine (CLC) and the soluble receptor cytokine-like factor 1 (CLF) [Elson G. C. A. et al (2000) Nature *Neuroscience* 3: 867-872]. CLC is a protein of the IL-6 family of cytokines and is also known as novel neurotrophin-1/B cell-stimulating factor-3 [Senaldi, G. et al (1999) *Proc. Nat. Acad. Sci. USA* 96: 11458-11463, U.S. Pat. No. 5,741,772]. CLF is homologous to proteins of the cytokine type I receptor family [Elson, G. C. A. et al (1998) *Journal of Immunol.* 161: 1371-1379] and has also been identified as NR6 [Alexander W. S. et al (1999) *Curr. Biol.* 9:605-608]. Heterodimers formed by association of CLC and CLF have been shown to directly interact with the CNTFR and the so formed trimeric complex is able to stimulate signalling events within cells expressing the other recognised components of the CNTFR complex such as gp130 and LIFR [Elson G. C. A. et al (2000) ibid].

Peptide sequences in human CLC with potential human MHC class II binding activity are shown in Table 22.

TABLE 22

| | | | |
|---|---|---|---|
| PGPSIQKTYDLTR, (SEQ ID NO: 1196) | PSIQKTYDLTRYL, (SEQ ID NO: 1197) | IQKTYDLTRYLEH, (SEQ ID NO: 1198) | KTYDLTRYLEHQL, (SEQ ID NO: 1199) |
| YDLTRYLEHQLRS, (SEQ ID NO: 1200) | LTRYLEHQLRSLA, (SEQ ID NO: 1201) | TRYLEHQLRSLAG, (SEQ ID NO: 1202) | RYLEHQLRSLAGT, (SEQ ID NO: 1203) |
| HQLRSLAGTYLNY, (SEQ ID NO: 1204) | QLRSLAGTYLNYL, (SEQ ID NO: 1205) | RSLAGTYLNYLGP, (SEQ ID NO: 1206) | GTYLNYLGPPFNE, (SEQ ID NO: 1207) |
| TYLNYLGPPFNEP, (SEQ ID NO: 1208) | NYLGPPFNEPDFN, (SEQ ID NO: 1209) | PPFNEPDFNPPRL, (SEQ ID NO: 1210) | PFNEPDFNPPRLG, (SEQ ID NO: 1211) |
| PDFNPPRLGAETL, (SEQ ID NO: 1212) | FNPPRLGAETLPR, (SEQ ID NO: 1213) | PRLGAETLPRATV, (SEQ ID NO: 1214) | LGAETLPRATVDL, (SEQ ID NO: 1215) |
| ETLPRATVDLEVW, (SEQ ID NO: 1216) | PRATVDLEVWRSL, (SEQ ID NO: 1217) | ATVDLEVWRSLND, (SEQ ID NO: 1218) | TVDLEVWRSLNDK, (SEQ ID NO: 1219) |
| VDLEVWRSLNDKL, (SEQ ID NO: 1220) | LEVWRSLNDKLRL, (SEQ ID NO: 1221) | EVWRSLNDKLRLT, (SEQ ID NO: 1222) | VWRSLNDKLRLTQ, (SEQ ID NO: 1223) |
| RSLNDKLRLTQNY, (SEQ ID NO: 1224) | DKLRLTQNYEAYS, (SEQ ID NO: 1225) | KLRLTQNYEAYSH, (SEQ ID NO: 1226) | LRLTQNYEAYSHL, (SEQ ID NO: 1227) |
| TQNYEAYSHLLCY, (SEQ ID NO: 1228) | QNYEAYSHLLCYL, (SEQ ID NO: 1229) | EAYSHLLCYLRGL, (SEQ ID NO: 1230) | SHLLCYLRGLNRQ, (SEQ ID NO: 1231) |
| HLLCYLRGLNRQA, (SEQ ID NO: 1232) | LCYLRGLNRQAAT, (SEQ ID NO: 1233) | CYLRGLNRQAATA, (SEQ ID NO: 1234) | RGLNRQAATAELR, (SEQ ID NO: 1235) |
| GLNRQAATAELRR, (SEQ ID NO: 1236) | QAATAELRRSLAH, (SEQ ID NO: 1237) | AATAELRRSLAHF, (SEQ ID NO: 1238) | AELRRSLAHFCTS, (SEQ ID NO: 1239) |
| ELRRSLAHFCTSL, (SEQ ID NO: 1240) | RSLAHFCTSLQGL, (SEQ ID NO: 1241) | AHFCTSLQGLLGS, (SEQ ID NO: 1242) | TSLQGLLGSIAGV, (SEQ ID NO: 1243) |
| SLQGLLGSIAGVM, (SEQ ID NO: 1244) | QGLLGSIAGVMAA, (SEQ ID NO: 1245) | GLLGSIAGVMAAL, (SEQ ID NO: 1246) | LLGSIAGVMAALG, (SEQ ID NO: 1247) |
| GSIAGVMAALGYP, (SEQ ID NO: 1248) | SIAGVMAALGYPL, (SEQ ID NO: 1249) | AGVMAALGYPLPQ, (SEQ ID NO: 1250) | GVMAALGYPLPQP, (SEQ ID NO: 1251) |
| AALGYPLPQPLPG, (SEQ ID NO: 1252) | LGYPLPQPLPGTE, (SEQ ID NO: 1253) | YPLPQPLPGTEPT, (SEQ ID NO: 1254) | QPLPGTEPTWTPG, (SEQ ID NO: 1255) |
| PTWTPGPAHSDFL, (SEQ ID NO: 1256) | WTPGPAHSDFLQK, (SEQ ID NO: 1257) | HSDFLQKMDDFWL, (SEQ ID NO: 1258) | SDFLQKMDDFWLL, (SEQ ID NO: 1259) |
| DFLQKMDDFWLLK, (SEQ ID NO: 1260) | FLQKMDDFWLLKE, (SEQ ID NO: 1261) | QKMDDFWLLKELQ, (SEQ ID NO: 1262) | DDFWLLKELQTWL, (SEQ ID NO: 1263) |
| DFWLLKELQTWLW, (SEQ ID NO: 1264) | FWLLKELQTWLWR, (SEQ ID NO: 1265) | WLLKELQTWLWRS, (SEQ ID NO: 1266) | KELQTWLWRSAKD, (SEQ ID NO: 1267) |
| ELQTWLWRSAKDF, (SEQ ID NO: 1268) | QTWLWRSAKDFNR, (SEQ ID NO: 1269) | TWLWRSAKDFNRL, (SEQ ID NO: 1270) | WLWRSAKDFNRLK, (SEQ ID NO: 1271) |
| WRSAKDFNRLKKK, (SEQ ID NO: 1272) | RSAKDFNRLKKKM, (SEQ ID NO: 1273) | KDFNRLKKKMQPP, (SEQ ID NO: 1274) | NRLKKKMQPPAAA, (SEQ ID NO: 1275) |

TABLE 22-continued

| | | | |
|---|---|---|---|
| RLKKKMQPPAAAV, (SEQ ID NO: 1276) | LKKKMQPPAAAVT, (SEQ ID NO: 1277) | KKMQPPAAAVTLH, (SEQ ID NO: 1278) | KMQPPAAAVTLHL, (SEQ ID NO: 1279) |
| QPPAAAVTLHLGA. (SEQ ID NO: 1280) | | | |

Peptide sequences in human CLF with potential human MHC class II binding activity are shown in Table 23.

TABLE 23

| | | | |
|---|---|---|---|
| TAVISPQDPTLLI, (SEQ ID NO: 1281) | AVISPQDPTLLIG, (SEQ ID NO: 1282) | VISPQDPTLLIGS, (SEQ ID NO: 1283) | QDPTLLIGSSLLA, (SEQ ID NO: 1284) |
| DPTLLIGSSLLAT, (SEQ ID NO: 1285) | PTLLIGSSLLATC, (SEQ ID NO: 1286) | TLLIGSSLLATCS, (SEQ ID NO: 1287) | LLIGSSLLATCSV, (SEQ ID NO: 1288) |
| IGSSLLATCSVHG, (SEQ ID NO: 1289) | SSLLATCSVHGDP, (SEQ ID NO: 1290) | SLLATCSVHGDPP, (SEQ ID NO: 1291) | CSVHGDPPGATAE, (SEQ ID NO: 1292) |
| GDPPGATAEGLYW, (SEQ ID NO: 1293) | EGLYWTLNGRRLP, (SEQ ID NO: 1294) | GLYWTLNGRRLPP, (SEQ ID NO: 1295) | WTLNGRRLPPELS, (SEQ ID NO: 1296) |
| RRLPPELSRVLNA, (SEQ ID NO: 1297) | RLPPELSRVLNAS, (SEQ ID NO: 1298) | PELSRVLNASTLA, (SEQ ID NO: 1299) | ELSRVLNASTLAL, (SEQ ID NO: 1300) |
| LSRVLNASTLALA, (SEQ ID NO: 1301) | SRVLNASTLALAL, (SEQ ID NO: 1302) | RVLNASTLALALA, (SEQ ID NO: 1303) | LNASTLALALANL, (SEQ ID NO: 1304) |
| NASTLALALANLN, (SEQ ID NO: 1305) | STLALALANLNGS, (SEQ ID NO: 1306) | LALALANLNGSRQ, (SEQ ID NO: 1307) | LALANLNGSRQRS, (SEQ ID NO: 1308) |
| ANLNGSRQRSGDN, (SEQ ID NO: 1309) | DNLVCHARDGSIL, (SEQ ID NO: 1310) | NLVCHARDGSILA, (SEQ ID NO: 1311) | VCHARDGSILAGS, (SEQ ID NO: 1312) |
| RDGSILAGSCLYV, (SEQ ID NO: 1313) | DGSILAGSCLYVG, (SEQ ID NO: 1314) | GSILAGSCLYVGL, (SEQ ID NO: 1315) | SILAGSCLYCGLP, (SEQ ID NO: 1316) |
| SCLYVGLPPEKPV, (SEQ ID NO: 1317) | CLYVGLPPEKPVN, (SEQ ID NO: 1318) | LYVGLPPEKPVNI, (SEQ ID NO: 1319) | VGLPPEKPVNISC, (SEQ ID NO: 1320) |
| KPVNISCWSKNMK, (SEQ ID NO: 1321) | VNISCWSKNMKDL, (SEQ ID NO: 1322) | KNMKDLTCRWTPG, (SEQ ID NO: 1323) | KDLTCRWTPGAHG, (SEQ ID NO: 1324) |
| CRWTPGAHGETFL, (SEQ ID NO: 1325) | RWTPGAHGETFLH, (SEQ ID NO: 1326) | HGETFLHTNYSLK, (SEQ ID NO: 1327) | ETFLHTNYSLKYK, (SEQ ID NO: 1328) |
| TFLHTNYSLKYKL, (SEQ ID NO: 1329) | TNYSLKYKLRWYG, (SEQ ID NO: 1330) | YSLKYKLRWYGQD, (SEQ ID NO: 1331) | LKYKLRWYGQDNT, (SEQ ID NO: 1332) |
| YKLRWYGQDNTCE, (SEQ ID NO: 1333) | LRWYGQDNTCEEY, (SEQ ID NO: 1334) | RWYGQDNTCEEYH, (SEQ ID NO: 1335) | EEYHTVGPHSCHI, (SEQ ID NO: 1336) |
| HTVGPHSCHIPKD, (SEQ ID NO: 1337) | PHSCHIPKDLALF, (SEQ ID NO: 1338) | CHIPKDLALFTPY, (SEQ ID NO: 1339) | IPKDLALFTPYEI, (SEQ ID NO: 1340) |
| KDLALFTPYEIWV, (SEQ ID NO: 1341) | ALFTPYEIWVEAT, (SEQ ID NO: 1342) | TPYEIWVEATNRL, (SEQ ID NO: 1343) | YEIWVEATNRLGS, (SEQ ID NO: 1344) |

TABLE 23-continued

| | | | |
|---|---|---|---|
| EIWVEATNRLGSA, (SEQ ID NO: 1345) | IWVEATNRLGSAR, (SEQ ID NO: 1346) | EIWVEATNRLGSA, (SEQ ID NO: 1347) | NRLGSARSDVLTL, (SEQ ID NO: 1348) |
| EATNRLGSARSDV, (SEQ ID NO: 1349) | SARSDVLTLDILD, (SEQ ID NO: 1350) | SDVLTLDILDVVT, (SEQ ID NO: 1351) | DVLTLDILDVVTT, (SEQ ID NO: 1352) |
| LTLDILDVVTTDP, (SEQ ID NO: 1353) | LDILDVVTTDPPP, (SEQ ID NO: 1354) | DILDVVTTDPPPD, (SEQ ID NO: 1355) | LDVVTTDPPPDVH, (SEQ ID NO: 1356) |
| ARSDVLTLDILDV, (SEQ ID NO: 1357) | PDVHVSRVGGLED, (SEQ ID NO: 1358) | VHVSRVGGLEDQL, (SEQ ID NO: 1359) | SRVGGLEDQLSVR, (SEQ ID NO: 1360) |
| DVVTTDPPPDVHV, (SEQ ID NO: 1361) | GGLEDQLSVRWVS, (SEQ ID NO: 1362) | RVGGLEDQLSVRW, (SEQ ID NO: 1363) | DQLSVRWVSPPAL, (SEQ ID NO: 1364) |
| LSVRWVSPPALKD, (SEQ ID NO: 1365) | VRWVSPPALKDFL, (SEQ ID NO: 1366) | RWVSPPALKDFLF, (SEQ ID NO: 1367) | GLEDQLSVRWVSP, (SEQ ID NO: 1368) |
| PALKDFLFQAKYQ, (SEQ ID NO: 1369) | KDFLFQAKYQIRY, (SEQ ID NO: 1370) | DFLFQAKYQIRYR, (SEQ ID NO: 1371) | FLFQAKYQIRYRV, (SEQ ID NO: 1372) |
| VSPPALKDFLFQA, (SEQ ID NO: 1373) | AKYQIRYRVEDSV, (SEQ ID NO: 1374) | YQIRYRVEDSVDW, (SEQ ID NO: 1375) | IRYRVEDSVDWKV, (SEQ ID NO: 1376) |
| YRVEDSVDWKVVD, (SEQ ID NO: 1377) | FQAKYQIRYRVED, (SEQ ID NO: 1378) | DSVDWKVVDDVSN, (SEQ ID NO: 1379) | VDWKVVDDVSNQT, (SEQ ID NO: 1380) |
| VEDSVDWKVVDDV, (SEQ ID NO: 1381) | KVVDDVSNQTSCR, (SEQ ID NO: 1382) | DDVSNQTSCRLAG, (SEQ ID NO: 1383) | WKVVDDVSNQTSC, (SEQ ID NO: 1384) |
| QTSCRLAGLKPGT, (SEQ ID NO: 1385) | CRLAGLKPGTVYF, (SEQ ID NO: 1386) | AGLKPGTVYFVQV, (SEQ ID NO: 1387) | GTVYFVQVRCNPF, (SEQ ID NO: 1388) |
| TVYFVQVRCNPFG, (SEQ ID NO: 1389) | VYFVQVRCNPFGI, (SEQ ID NO: 1390) | FVQVRCNPFGIYG, (SEQ ID NO: 1391) | VQVRCNPFGIYGS, (SEQ ID NO: 1392) |
| NPFGIYGSKKAGI, (SEQ ID NO: 1393) | PFGIYGSKKAGIW, (SEQ ID NO: 1394) | FGIYGSKKAGIWS, (SEQ ID NO: 1395) | GIYGSKKAGIWSE, (SEQ ID NO: 1396) |
| SKKAGIWSEWSHP, (SEQ ID NO: 1397) | AGIWSEWSHPTAA, (SEQ ID NO: 1398) | GIWSEWSHPTAAS, (SEQ ID NO: 1399) | SEWSHPTAASTPR, (SEQ ID NO: 1400) |
| SHPTAASTPRSER, (SEQ ID NO: 1401) | PSSGPVRRELKQF, (SEQ ID NO: 1402) | GPVRRELKQFLGW, (SEQ ID NO: 1403) | RELKQFLGWLKKH, (SEQ ID NO: 1404) |
| KQFLGWLKKHAYC, (SEQ ID NO: 1405) | QFLGWLKKHAYCS, (SEQ ID NO: 1406) | LGWLKKHAYCSNL, (SEQ ID NO: 1407) | GWLKKHAYCSNLS, (SEQ ID NO: 1408) |
| HAYCSNLSFRLYD, (SEQ ID NO: 1409) | AYCSNLSFRLYDQ, (SEQ ID NO: 1410) | SNLSFRLYDQWRA, (SEQ ID NO: 1411) | LSFRLYDQWRAWM, (SEQ ID NO: 1412) |
| FRLYDQWRAWMQK, (SEQ ID NO: 1413) | RLYDQWRAWMQKS, (SEQ ID NO: 1414) | DQWRAWMQKSHKT, (SEQ ID NO: 1415) | RAWMQKSHKTRNQ, (SEQ ID NO: 1416) |
| AWMQKSHKTRNQD, (SEQ ID NO: 1417) | HKTRNQDEGILPS, (SEQ ID NO: 1418) | EGILPSGRRGTAR, (SEQ ID NO: 1419) | GILPSGRRGTARG. (SEQ ID NO: 1420) |

EXAMPLE 16

(Follicle-stimulating Hormone)

The present invention provides for modified forms of human hFSH with one or more T cell epitopes removed. hFSH is a glycoprotein hormone with a dimeric structure containing two glycoprotein subunits. The protein is being used therapeutically in the treatment of human infertility and a recombinant form of the protein has been the subject of a number of clinical trials [Out, H. J. et al (1995) *Hum. Reprod.* 10: 2534-2540; Hedon, B. et al (1995) *Hum. Reprod.* 10: 3102-3106; Recombinant Human FSH study Group (1995) *Fertil. Steril.* 63: 77-86 Prevost, R. R. (1998) *Pharmacotherapy* 18: 1001-1010].

Peptide sequences in human hFSH with potential human MHC class II binding activity are shown in Table 24.

TABLE 24

| | | | |
|---|---|---|---|
| KTLQFFFLFCCWK, (SEQ ID NO: 1421) | LQFFFLFCCWKAI, (SEQ ID NO: 1422) | QFFFLFCCWKAIC, (SEQ ID NO: 1423) | FFFLFCCWKAICC, (SEQ ID NO: 1424) |
| FFLFCCWKAICCN, (SEQ ID NO: 1425) | FLFCCWKAICCNS, (SEQ ID NO: 1426) | CCWKAICCNSCEL, (SEQ ID NO: 1427) | KAICCNSCELTNI, (SEQ ID NO: 1428) |
| CELTNITIAIEKE, (SEQ ID NO: 1429) | TNITIAIEKEECR, (SEQ ID NO: 1430) | ITIAIEKEECRFC, (SEQ ID NO: 1431) | IAIEKEECRFCIS, (SEQ ID NO: 1432) |
| CRFCISINTTWCA, (SEQ ID NO: 1433) | FCISINTTWCAGY, (SEQ ID NO: 1434) | ISINTTWCAGYCY, (SEQ ID NO: 1435) | TTWCAGYCYTRDL, (SEQ ID NO: 1436) |
| AGYCYTRDLVYKD, (SEQ ID NO: 1437) | YCYTRDLVYKDPA, (SEQ ID NO: 1438) | RDLVYKDPARPKI, (SEQ ID NO: 1439) | DLVYKDPARPKIQ, (SEQ ID NO: 1440) |
| LVYKDPARPKIQK, (SEQ ID NO: 1441) | PKIQKTCTFKELV, (SEQ ID NO: 1442) | CTFKELVYETVRV, (SEQ ID NO: 1443) | KELVYETVRVPGC, (SEQ ID NO: 1444) |
| ELVYETVRVPGCA, (SEQ ID NO: 1445) | LVYETVRVPGCAH, (SEQ ID NO: 1446) | ETVRVPGCAHHAD, (SEQ ID NO: 1447) | VRVPGCAHHADSL, (SEQ ID NO: 1448) |
| DSLYTYPVATQCH, (SEQ ID NO: 1449) | SLYTYPVATQCHC, (SEQ ID NO: 1450) | YTYPVATQCHCGK, (SEQ ID NO: 1451) | YPVATQCHCGKCD, (SEQ ID NO: 1452) |
| CTVRGLGPSYCSF, (SEQ ID NO: 1453) | RGLGPSYCSFGEM. (SEQ ID NO: 1454) | | |

EXAMPLE 16

(Ricin A)

The present invention provides for modified forms of ricin toxin A-chain (RTA) with one or more T cell epitopes removed. Ricin is a cytotoxin originally isolated from the seeds of the castor plant and is an example of a type II ribosome inactivating protein (RIP). The native mature protein is a heterodimer comprising the RTA of 267 amino acid residues in disulphide linkage with the ricin B-chain of 262 amino acid residues. The B-chain is a lectin with binding affinity for galactosides. The native protein is able to bind cells via the B-chain and enters the cell by endocytosis. Inside the cell, the RTA is released from the B-chain by reduction of the disulphide linkage and is released from the endosome into the cytoplasm via unknown mechanisms. In the cytoplasm the toxin degrades ribosomes by action as a specific N-glycosylase rapidly resulting in the cessation of protein translation and cell death. The extreme cytotoxicity of RTA and other RIPs has lead to their use in experimental therapies for the treatment of cancer and other diseases where ablation of a particular cell population is required. Immunotoxin molecules containing antibody molecules in linkage with RTA have been produced and used in a number of clinical trials [Ghetie, M. A. et al (1991) *Cancer Res.* 51: 5876-5880; Vitetta, E. S. et al (1991) *Cancer Res.* 51: 4052-4058; Amlot, P. L. et al (1993) *Blood* 82: 2624-2633; Conry, R. M. et al (1995) *J. Immunother. Emphasis Tumor Immunol.* 18: 231-241; Schnell, R. et al (2000) *Leukaemia* 14: 129-135]. In the immunotoxin the antibody domain provides binding to the surface of the desired target cell and linkage to the RTA may be via chemical cross-linkage or as a recombinant fusion protein.

Peptide sequences in ricin toxin a-chain with potential human MHC class II binding activity are shown in Table 25.

TABLE 25

| | | | |
|---|---|---|---|
| KQYPIINFTTAGA, (SEQ ID NO: 1455) | YPIINFTTAGATV, (SEQ ID NO: 1456) | PIINFTTAGATVQ, (SEQ ID NO: 1457) | INFTTAGATVQSY, (SEQ ID NO: 1458) |
| ATVQSYTNFIRAV, (SEQ ID NO: 1459) | QSYTNFIRAVRGR, (SEQ ID NO: 1460) | TNFIRAVRGRLTT, (SEQ ID NO: 1461) | NFIRAVRGRLTTG, (SEQ ID NO: 1462) |
| RAVRGRLTTGADV, (SEQ ID NO: 1463) | GRLTTGADVRHEI, (SEQ ID NO: 1464) | ADVRHEIPVLPNR, (SEQ ID NO: 1465) | HEIPVLPNRVGLP, (SEQ ID NO: 1466) |
| IPVLPNRVGLPIN, (SEQ ID NO: 1467) | PVLPNRVGLPINQ, (SEQ ID NO: 1468) | NRVGLPINQRFIL, (SEQ ID NO: 1469) | VGLPINQRFILVE, (SEQ ID NO: 1470) |
| LPINQRFILVELS, (SEQ ID NO: 1471) | QRFILVELSNHAE, (SEQ ID NO: 1472) | RFILVELSNHAEL, (SEQ ID NO: 1473) | FILVELSNHAELS, (SEQ ID NO: 1474) |
| ILVELSNHAELSV, (SEQ ID NO: 1475) | VELSNHAELSVTL, (SEQ ID NO: 1476) | AELSVTLALDVTN, (SEQ ID NO: 1477) | LSVTLALDVTNAY, (SEQ ID NO: 1478) |
| VTLALDVTNAYVV, (SEQ ID NO: 1479) | LALDVTNAYVVGY, (SEQ ID NO: 1480) | LDVTNAYVVGYRA, (SEQ ID NO: 1481) | NAYVVGYRAGNSA, (SEQ ID NO: 1482) |
| AYVVGYRAGNSAY, (SEQ ID NO: 1483) | YVVGYRAGNSAYF, (SEQ ID NO: 1484) | VGYRAGNSAYFFH, (SEQ ID NO: 1485) | SAYFFHPDNQEDA, (SEQ ID NO: 1486) |
| AYFFHPDNQEDAE, (SEQ ID NO: 1487) | YFFHPDNQEDAEA, (SEQ ID NO: 1488) | EAITHLFTDVQNR, (SEQ ID NO: 1489) | THLFTDVQNRYTF, (SEQ ID NO: 1490) |
| HLFTDVQNRYTFA, (SEQ ID NO: 1491) | TDVQNRYTFAFGG, (SEQ ID NO: 1492) | NRYTFAFGGNYDR, (SEQ ID NO: 1493) | YTFAFGGNYDRLE, (SEQ ID NO: 1494) |
| FAFGGNYDRLEQL, (SEQ ID NO: 1495) | GNYDRLEQLAGNL, (SEQ ID NO: 1496) | DRLEQLAGNLREN, (SEQ ID NO: 1497) | EQLAGNLRENIEL, (SEQ ID NO: 1498) |
| GNLRENIELGNGP, (SEQ ID NO: 1499) | ENIELGNGPLEEA, (SEQ ID NO: 1500) | IELGNGPLEEAIS, (SEQ ID NO: 1501) | GPLEEAISALYYY, (SEQ ID NO: 1502) |
| EAISALYYYSTGG, (SEQ ID NO: 1503) | SALYYYSTGGTQL, (SEQ ID NO: 1504) | ALYYYSTGGTQLP, (SEQ ID NO: 1505) | LYYYSTGGTQLPT, (SEQ ID NO: 1506) |
| YYYSTGGTQLPTL, (SEQ ID NO: 1507) | TQLPTLARSFIIC, (SEQ ID NO: 1508) | PTLARSFIICIQM, (SEQ ID NO: 1509) | RSFIICIQMISEA, (SEQ ID NO: 1510) |
| SFIICIQMISEAA, (SEQ ID NO: 1511) | FIICIQMISEAAR, (SEQ ID NO: 1512) | ICIQMISEAARFQ, (SEQ ID NO: 1513) | IQMISEAARFQYI, (SEQ ID NO: 1514) |
| QMISEAARFQYIE, (SEQ ID NO: 1515) | ARFQYIEGEMRTR, (SEQ ID NO: 1516) | FQYIEGEMRTRIR, (SEQ ID NO: 1517) | QYIEGEMRTRIRY, (SEQ ID NO: 1518) |
| GEMRTRIRYNRRS, (SEQ ID NO: 1519) | TRIRYNRRSAPDP, (SEQ ID NO: 1520) | IRYNRRSAPDPSV, (SEQ ID NO: 1521) | PSVITLENSWGRL, (SEQ ID NO: 1522) |
| SVITLENSWGRLS, (SEQ ID NO: 1523) | ITLENSWGRLSTA, (SEQ ID NO: 1524) | NSWGRLSTAIQES, (SEQ ID NO: 1525) | GRLSTAIQESNQG, (SEQ ID NO: 1526) |
| TAIQESNQGAFAS, (SEQ ID NO: 1527) | GAFASPIQLQRRN, (SEQ ID NO: 1528) | SPIQLQRRNGSKF, (SEQ ID NO: 1529) | IQLQRRNGSKFSV, (SEQ ID NO: 1530) |
| SKFSVYDVSILIP, (SEQ ID NO: 1531) | FSVYDVSILIPII, (SEQ ID NO: 1532) | SVYDVSILIPIIA, (SEQ ID NO: 1533) | YDVSILIPIIALM, (SEQ ID NO: 1534) |

TABLE 25-continued

| | | | |
|---|---|---|---|
| VSILIPIIALMVY, (SEQ ID NO: 1535) | SILIPIIALMVYR, (SEQ ID NO: 1536) | IPIIALMVYRCAP, (SEQ ID NO: 1537) | IALMVYRCAPPPS, (SEQ ID NO: 1538) |
| ALMVYRCAPPPSS, (SEQ ID NO: 1539) | LMVYRCAPPPSSQ, (SEQ ID NO: 1540) | MVYRCAPPPSSQF. (SEQ ID NO: 1541) | |

EXAMPLE 17

(Adipocyte Complement Related Protein)

The present invention provides for modified forms of human or mouse Acrp30 with one or more T cell epitopes removed. Acrp30 is an abundant serum protein of approximately 30 kDa molecular weight expressed exclusively by adipocyte cells [Scherer, P. E. et al (1995) *J. Biol. Chem.* 270: 26746-26749]. The human gene Acrp30 protein sequence is disclosed e.g. in U.S. Pat. No. 5,869,330. Secretion of the protein is enhanced by insulin and levels of the protein are decreased in obese subjects. The protein is involved in the regulation of energy balance and in particular the regulation of fatty acid metabolism. Four sequence domains are identified in the mouse and human protein comprising a cleaved N-terminal signal, a region with no recognized homology to other proteins, a collagen-like domain and a globular domain. The globular domain may be removed from the mouse protein by protease treatment to produce gAcrp30. Preparations of murine gAcrp30 have pharmaceutical properties and have been shown to decrease elevated levels of free fatty acids in the serum of mice following administration of high fat meals or i.v. injection of lipid [Fruebis, J. et al (2001) *Proc. Natl. Acad. Sci. U.S.A.* 98: 2005-2010].

Peptide sequences in mouse Acrp30 with potential human MHC class II binding activity are shown in Table 26.

TABLE 26

| | | | |
|---|---|---|---|
| DDVTTTEELAPAL, (SEQ ID NO: 1542) | TTTEELAPALVPP, (SEQ ID NO: 1543) | EELAPALVPPPKG, (SEQ ID NO: 1544) | LAPALVPPPKGTC, (SEQ ID NO: 1545) |
| PALVPPPKGTCAG, (SEQ ID NO: 1546) | ALVPPPKGTCAGW, (SEQ ID NO: 1547) | AGWMAGIPGHPGH, (SEQ ID NO: 1548) | GWMAGIPGHPGHN, (SEQ ID NO: 1549) |
| AGIPGHPGHNGTP, (SEQ ID NO: 1550) | GTPGRDGRDGTPG, (SEQ ID NO: 1551) | GDAGLLGPKGETG, (SEQ ID NO: 1552) | AGLLGPKGETGDV, (SEQ ID NO: 1553) |
| GLLGPKGETGDVG, (SEQ ID NO: 1554) | GETGDVGMTGAEG, (SEQ ID NO: 1555) | GDVGMTGAEGPRG, (SEQ ID NO: 1556) | VGMTGAEGPRGFP, (SEQ ID NO: 1557) |
| RGFPGTPGRKGEP, (SEQ ID NO: 1558) | TPGRKGEPGEAAY, (SEQ ID NO: 1559) | GRKGEPGEAAYMY, (SEQ ID NO: 1560) | AAYMYRSAFSVGL, (SEQ ID NO: 1561) |
| AYMYRSAFSVGLE, (SEQ ID NO: 1562) | YMYRSAFSVGLET, (SEQ ID NO: 1563) | SAFSVGLETRVTV, (SEQ ID NO: 1564) | FSVGLETRVTVPN, (SEQ ID NO: 1565) |
| VGLETRVTVPNVP, (SEQ ID NO: 1566) | GLETRVTVPNVPI, (SEQ ID NO: 1567) | ETRVTVPNVPIRF, (SEQ ID NO: 1568) | TRVTVPNVPIRFT, (SEQ ID NO: 1569) |
| VTVPNVPIRFTKI, (SEQ ID NO: 1570) | VPNVPIRFTKIFY, (SEQ ID NO: 1571) | PNVPIRFTKIFYN, (SEQ ID NO: 1572) | VPIRFTKIFYNQQ, (SEQ ID NO: 1573) |
| IRFTKIFYNQQNH, (SEQ ID NO: 1574) | RFTKIFYNQQNHY, (SEQ ID NO: 1575) | TKIFYNQQNHYDG, (SEQ ID NO: 1576) | KIFYNQQNHYDGS, (SEQ ID NO: 1577) |
| IFYNQQNHYDGST, (SEQ ID NO: 1578) | QQNHYDGSTGKFY, (SEQ ID NO: 1579) | NHYDGSTGKFYCN, (SEQ ID NO: 1580) | GKFYCNIPGLYYF, (SEQ ID NO: 1581) |
| KFYCNIPGLYYFS, (SEQ ID NO: 1582) | CNIPGLYYFSYHI, (SEQ ID NO: 1583) | PGLYYFSYHITVY, (SEQ ID NO: 1584) | GLYYFSYHITVYM, (SEQ ID NO: 1585) |
| LYYFSYHITVYMK, (SEQ ID NO: 1586) | YYFSYHITVYMKD, (SEQ ID NO: 1587) | FSYHITVYMKDVK, (SEQ ID NO: 1588) | SYHITVYMKDVKV, (SEQ ID NO: 1589) |

TABLE 26-continued

| | | | |
|---|---|---|---|
| YHITVYMKDVKVS, (SEQ ID NO: 1590) | HITVYMKDVKVSL, (SEQ ID NO: 1591) | ITVYMKDVKVSLF, (SEQ ID NO: 1592) | TVYMKDVKVSLFK, (SEQ ID NO: 1593) |
| VYMKDVKVSLFKK, (SEQ ID NO: 1594) | KDVKVSLFKKDKA, (SEQ ID NO: 1595) | VKVSLFKKDKAVL, (SEQ ID NO: 1596) | VSLFKKDKAVLFT, (SEQ ID NO: 1597) |
| SLFKKDKAVLFTY, (SEQ ID NO: 1598) | FKKDKAVLFTYDQ, (SEQ ID NO: 1599) | KDKAVLFTYDQYQ, (SEQ ID NO: 1600) | KAVLFTYDQYQEK, (SEQ ID NO: 1601) |
| AVLFTYDQYQEKN, (SEQ ID NO: 1602) | VLFTYDQYQEKNV, (SEQ ID NO: 1603) | FTYDQYQEKNVDQ, (SEQ ID NO: 1604) | YDQYQEKNVDQAS, (SEQ ID NO: 1605) |
| DQYQEKNVDQASG, (SEQ ID NO: 1606) | EKNVDQASGSVLL, (SEQ ID NO: 1607) | KNVDQASGSVLLH, (SEQ ID NO: 1608) | ASGSVLLHLEVGD, (SEQ ID NO: 1609) |
| GSVLLHLEVGDQV, (SEQ ID NO: 1610) | SVLLHLEVGDQVW, (SEQ ID NO: 1611) | VLLHLEVGDQVWL, (SEQ ID NO: 1612) | LHLEVGDQVWLQV, (SEQ ID NO: 1613) |
| LEVGDQVWLQVYG, (SEQ ID NO: 1614) | DQVWLQVYGDGDH, (SEQ ID NO: 1615) | QVWLQVYGDGDHN, (SEQ ID NO: 1616) | VWLQVYGDGDHNG, (SEQ ID NO: 1617) |
| LQVYGDGDHNGLY, (SEQ ID NO: 1618) | QVYGDGDHNGLYA, (SEQ ID NO: 1619) | VYGDGDHNGLYAD, (SEQ ID NO: 1620) | GDHNGLYADNVND, (SEQ ID NO: 1621) |
| NGLYADNVNDSTF, (SEQ ID NO: 1622) | GLYADNVNDSTFT, (SEQ ID NO: 1623) | LYADNVNDSTFTG, (SEQ ID NO: 1624) | DNVNDSTFTGFLL, (SEQ ID NO: 1625) |
| VNDSTFTGFLLYH, (SEQ ID NO: 1626) | STFTGFLLYHDTN. (SEQ ID NO: 1627) | | |

Peptide sequences in human Acrp30 with potential human MHC class II binding activity are shown in Table 27.

TABLE 27

| | | | |
|---|---|---|---|
| PGVLLPLPKGACT, (SEQ ID NO: 1628) | GVLLPLPKGACTG, (SEQ ID NO: 1629) | VLLPLPKGACTGW, (SEQ ID NO: 1630) | LPLPKGACTGWMA, (SEQ ID NO: 1631) |
| PLPKGACTGWMAG, (SEQ ID NO: 1632) | TGWMAGIPGHPGH, (SEQ ID NO: 1633) | GWMAGIPGHPGHN, (SEQ ID NO: 1634) | AGIPGHPGHNGAP, (SEQ ID NO: 1635) |
| GAPGRDGRDGTPG, (SEQ ID NO: 1636) | GDPGLIGPKGDIG, (SEQ ID NO: 1637) | PGLIGPKGDIGET, (SEQ ID NO: 1638) | GLIGPKGDIGETG, (SEQ ID NO: 1639) |
| GPKGDIGETGVPG, (SEQ ID NO: 1640) | GDIGETGVPGAEG, (SEQ ID NO: 1641) | TGVPGAEGPRGFP, (SEQ ID NO: 1642) | RGFPGIQGRKGEP, (SEQ ID NO: 1643) |
| PGIQGRKGEPGEG, (SEQ ID NO: 1644) | GRKGEPGEGAYVY, (SEQ ID NO: 1645) | GAYVYRSAFSVGL, (SEQ ID NO: 1646) | AYVYRSAFSVGLE, (SEQ ID NO: 1647) |
| YVYRSAFSVGLET, (SEQ ID NO: 1648) | RSAFSVGLETYVT, (SEQ ID NO: 1649) | SAFSVGLETYVTI, (SEQ ID NO: 1650) | AFSVGLETYVTIP, (SEQ ID NO: 1651) |
| FSVGLETYVTIPN, (SEQ ID NO: 1652) | VGLETYVTIPNMP, (SEQ ID NO: 1653) | GLETYVTIPNMPI, (SEQ ID NO: 1654) | ETYVTIPNMPIRF, (SEQ ID NO: 1655) |
| TYVTIPNMPIRFT, (SEQ ID NO: 1656) | VTIPNMPIRFTKI, (SEQ ID NO: 1657) | IPNMPIRFTKIFY, (SEQ ID NO: 1658) | PNMPIRFTKIFYN, (SEQ ID NO: 1659) |

TABLE 27-continued

| | | | |
|---|---|---|---|
| MPIRFTKIFYNQQ, (SEQ ID NO: 1660) | IRFTKIFYNQQNH, (SEQ ID NO: 1661) | RFTKIFYNQQNHY, (SEQ ID NO: 1662) | TKIFYNQQNHYDG, (SEQ ID NO: 1663) |
| KIFYNQQNHYDGS, (SEQ ID NO: 1664) | IFYNQQNHYDGST, (SEQ ID NO: 1665) | QQNHYDGSTGKFH, (SEQ ID NO: 1666) | NHYDGSTGKFHCN, (SEQ ID NO: 1667) |
| GKFHCNIPGLYYF, (SEQ ID NO: 1668) | CNIPGLYYFAYHI, (SEQ ID NO: 1669) | PGLYYFAYHITVY, (SEQ ID NO: 1670) | GLYYFAYHITVYM, (SEQ ID NO: 1671) |
| LYYFAYHITVYMK, (SEQ ID NO: 1672) | YYFAYHITVYMKD, (SEQ ID NO: 1673) | FAYHITVYMKDVK, (SEQ ID NO: 1674) | AYHITVYMKDVKV, (SEQ ID NO: 1675) |
| YHITVYMKDVKVS, (SEQ ID NO: 1676) | HITVYMKDVKVSL, (SEQ ID NO: 1677) | ITVYMKDVKVSLF, (SEQ ID NO: 1678) | TVYMKDVKVSLFK, (SEQ ID NO: 1679) |
| VYMKDVKVSLFKK, (SEQ ID NO: 1680) | KDVKVSLFKKDKA, (SEQ ID NO: 1681) | VKVSLFKKDKAML, (SEQ ID NO: 1682) | VSLFKKDKAMLFT, (SEQ ID NO: 1683) |
| SLFKKDKAMLFTY, (SEQ ID NO: 1684) | FKKDKAMLFTYDQ, (SEQ ID NO: 1685) | KDKAMLFTYDQYQ, (SEQ ID NO: 1686) | KAMLFTYDQYQEN, (SEQ ID NO: 1687) |
| AMLFTYDQYQENN, (SEQ ID NO: 1688) | MLFTYDQYQENNV, (SEQ ID NO: 1689) | FTYDQYQENNVDQ, (SEQ ID NO: 1690) | YDQYQENNVDQAS, (SEQ ID NO: 1691) |
| DQYQENNVDQASG, (SEQ ID NO: 1692) | ENNVDQASGSVLL, (SEQ ID NO: 1693) | NNVDQASGSVLLH, (SEQ ID NO: 1694) | ASGSVLLHLEVGD, (SEQ ID NO: 1695) |
| GSVLLHLEVGDQV, (SEQ ID NO: 1696) | SVLLHLEVGDQVW, (SEQ ID NO: 1697) | VLLHLEVGDQVWL, (SEQ ID NO: 1698) | LHLEVGDQVWLQV, (SEQ ID NO: 1699) |
| LEVGDQVWLQVYG, (SEQ ID NO: 1700) | DQVWLQVYGEGER, (SEQ ID NO: 1701) | QVWLQVYGEGERN, (SEQ ID NO: 1702) | VWLQVYGEGERNG, (SEQ ID NO: 1703) |
| LQVYGEGERNGLY, (SEQ ID NO: 1704) | QVYGEGERNGLYA, (SEQ ID NO: 1705) | NGLYADNDNDSTF, (SEQ ID NO: 1706) | GLYADNDNDSTFT, (SEQ ID NO: 1707) |
| LYADNDNDSTFTG, (SEQ ID NO: 1708) | DNDSTFTGFLLYH, (SEQ ID NO: 1709) | STFTGFLLYHDTN. (SEQ ID NO: 1710) | |

EXAMPLE 18

(Anti-C5 Antibody)

The present invention provides for modified forms of monoclonal antibodies with binding specificity directed to the human C5 complement protein. The invention provides for modified antibodies with one or more T cell epitopes removed. The antibodies with binding specificity to C5 complement protein block cleavage activation of the C5 convertase and thereby inhibit the production of the pro-inflammatory components C5a and C5b-9. Activation of the complement system is a significant contributory factor in the pathogenesis of a number of acute and chronic diseases, and inhibition of the complement cascade at the level of C5 offers significant promise as a therapeutic avenue for some of these [Morgan B. P. *Eur. J. Clin. Invest.* 24: 219-228]. A number of anti-C5 antibodies and methods for their therapeutic use have been described in the art [Wurzner R. et al (1991) *Complement. Inflamm.* 8: 382-340; Thomas, T. C. et al (1996) *Molecular Immunology* 33: 1389-14012; U.S. Pat. Nos. 5,853,722; 6,074,64]. The antibody designated 5G1.1 [Thomas, T. C. et al (1996) ibid] and a single-chain humanised variant are undergoing clinical trials for a number of disease indications including cardiopulmonary bypass [Fitch, J. C. K. et al (1999) *Circulation* 100: 2499-2506] and rheumatoid arthritis. The invention discloses sequences identified within the anti-C5 antibody designated 5G1.1 [Thomas, T. C. et al]. The sequences disclosed are derived from the variable region domains of both the heavy and light chains of the antibody sequence that are potential T cell epitopes by virtue of MHC class II binding potential. The disclosure further identifies potential epitopes within the protein sequence of a single-chain and "humanised" variant 5G1.1 antibody [Thomas, T. C. et al (1996) ibid].

Peptide sequences in the heavy-chain variable region of antibody 5G1.1 with potential human MHC class II binding activity are shown in Table 28.

TABLE 28

| | | | | |
|---|---|---|---|---|
| VQLQQSGAELMKP, (SEQ ID NO: 1711) | QSGAELMKPGASV, (SEQ ID NO: 1712) | AELMKPGASVKMS, (SEQ ID NO: 1713) | ELMKPGASVKMSC, (SEQ ID NO: 1714) | ASVKMSCKATGYI, (SEQ ID NO: 1715) |
| VKMSCKATGYIFS, (SEQ ID NO: 1716) | KMSCKATGYIFSN, (SEQ ID NO: 1717) | ATGYIFSNYWIQW, (SEQ ID NO: 1718) | TGYIFSNYWIQWI, (SEQ ID NO: 1719) | GYIFSNYWIQWIK, (SEQ ID NO: 1720) |
| YIFSNYWIQWIKQ, (SEQ ID NO: 1721) | SNYWIQWIKQRPG, (SEQ ID NO: 1722) | NYWIQWIKQRPGH, (SEQ ID NO: 1723) | YWIQWIKQRPGHG, (SEQ ID NO: 1724) | IQWIKQRPGHGLE, (SEQ ID NO: 1725) |
| QWIKQRPGHGLEW, (SEQ ID NO: 1726) | HGLEWIGEILPGS, (SEQ ID NO: 1727) | LEWIGEILPGSGS, (SEQ ID NO: 1728) | EWIGEILPGSGST, (SEQ ID NO: 1729) | WIGEILPGSGSTE, (SEQ ID NO: 1726) |
| GEILPGSGSTEYT, (SEQ ID NO: 1731) | EILPGSGSTEYTE, (SEQ ID NO: 1732) | TEYTENFKDKAAF, (SEQ ID NO: 1733) | EWFKDKAAFTADT, (SEQ ID NO: 1734) | FKDKAAFTADTSS, (SEQ ID NO: 1735) |
| KAAFTADTSSNTA, (SEQ ID NO: 1736) | AAFTADTSSNTAY, (SEQ ID NO: 1737) | TAYMQLSSLTSED, (SEQ ID NO: 1738) | AYMQLSSLTSEDS, (SEQ ID NO: 1739) | MQLSSLTSEDSAV, (SEQ ID NO: 1740) |
| SSLTSEDSAVYYC, (SEQ ID NO: 1741) | SLTSEDSAVYYCA, (SEQ ID NO: 1742) | TSEDSAVYYCARY, (SEQ ID NO: 1743) | SAVYYCARYFFGS, (SEQ ID NO: 1744) | AVYYCARYFFGSS, (SEQ ID NO: 1745) |
| VYYCARYFFGSSP, (SEQ ID NO: 1746) | CARYFFGSSPNWY, (SEQ ID NO: 1747) | ARYFFGSSPNWYF, (SEQ ID NO: 1748) | RYFFGSSPNWYFD, (SEQ ID NO: 1749) | YFFGSSPNWYFDV, (SEQ ID NO: 1750) |
| PNWYFDVWGAGTT, (SEQ ID NO: 1751) | NWYFDVWGAGTTV, (SEQ ID NO: 1752) | WYFDVWGAGTTVT, (SEQ ID NO: 1753) | FDVWGAGTTVTVS, (SEQ ID NO: 1754) | DVWGAGTTVTVSS. (SEQ ID NO: 1755) |

Peptide sequences in the light-chain variable region of antibody 5G1.1 with potential human MHC class II binding activity are shown in Table 29.

TABLE 29

| | | | | |
|---|---|---|---|---|
| IQMTQSPASLSAS, (SEQ ID NO: 1756) | ASLSASVGETVTI, (SEQ ID NO: 1757) | ASVGETVTITCGA, (SEQ ID NO: 1758) | ETVTITCGASENI, (SEQ ID NO: 1759) | VTITCGASENIYG, (SEQ ID NO: 1760) |
| TITCGASENIYGA, (SEQ ID NO: 1761) | ENIYGALNWYQRK, (SEQ ID NO: 1762) | NIYGALNWYQRKQ, (SEQ ID NO: 1763) | GALNWYQRKQGKS, (SEQ ID NO: 1764) | LNWYQRKQGKSPQ, (SEQ ID NO: 1765) |
| NWYQRKQGKSPQL, (SEQ ID NO: 1766) | GKSPQLLIYGATN, (SEQ ID NO: 1767) | PQLLIYGATNLAD, (SEQ ID NO: 1768) | QLLIYGATNLADG, (SEQ ID NO: 1769) | LLIYGATNLADGM, (SEQ ID NO: 1770) |
| LIYGATNLADGMS, (SEQ ID NO: 1771) | TNLADGMSSRFSG, (SEQ ID NO: 1772) | DGMSSRFSGSGSG, (SEQ ID NO: 1773) | SRFSGSGSGRQYY, (SEQ ID NO: 1774) | SGSGRQYYLKISS, (SEQ ID NO: 1775) |
| RQYYLKISSLHPD, (SEQ ID NO: 1776) | QYYLKISSLHPDD, (SEQ ID NO: 1777) | YYLKISSLHPDDV, (SEQ ID NO: 1778) | LKISSLHPDDVAT, (SEQ ID NO: 1779) | SSLHPDDVATYYC, (SEQ ID NO: 1780) |
| SLHPDDVATYYCQ, (SEQ ID NO: 1781) | DDVATYYCQNVLN, (SEQ ID NO: 1782) | ATYYCQNVLNTPL, (SEQ ID NO: 1783) | TYYCQNVLNTPLT, (SEQ ID NO: 1784) | YYCQNVLNTPLTF, (SEQ ID NO: 1785) |
| YCQNVLNTPLTFG, (SEQ ID NO: 1786) | CQNVLNTPLTFGA, (SEQ ID NO: 1787) | QNVLNTPLTFGAG, (SEQ ID NO: 1788) | NVLNTPLTFGAGT, (SEQ ID NO: 1789) | TPLTFGAGTKLEL. (SEQ ID NO: 1790) |

EXAMPLE 19

(Anti-CD20 Antibodies)

The present invention provides for modified forms of a monoclonal antibody with binding specificity to the human CD20 antigen. CD20 is a B-cell specific surface molecule expressed on pre-B and mature B-cells including greater than 90% of B-cell non-Hodgkin's lymphomas (NHL). Monoclonal antibodies and radioimmunoconjugates targeting of CD20 have emerged as new treatments for NHL. Significant examples include the monoclonal antibodies 2B8 [Reff, M. E. et al (1994) Blood 83: 435-445] and B1 [U.S. Pat. No. 6,090, 365]. The variable region domains of 2B8 have been cloned and combined with human constant region domains to produce a chimeric antibody designated C2B8 which is marketed as Rituxan™ in the USA [U.S. Pat. No. 5,776,456] or MabThera$^R$ (rituximab) in Europe. C2B8 is recognized as a valuable therapeutic agent for the treatment of NHL and other B-cell diseases [Maloney, D. G. et al (1997) J. Clin. Oncol. 15: 3266-3274; Maloney, D. G. et al (1997) Blood 90: 2188-2195]. The B1 antibody has similarly achieved registration for use as a NHL therapeutic although in this case the molecule (Bexxar™) is a $^{131}$I radioimmunoconjugate although the native (non-conjugated) antibody has utility in ex vivo purging regimens for autologous bone marrow transplantation therapies for lymphoma and refractory leukemia [Freedman, A. S. et al (1990), *J. Clin. Oncol.* 8: 784]. Despite the success of antibodies such as C2B8 (rituximab) and Bexxar™ there is a continued need for anti-CD20 analogues with enhanced properties.

Peptide sequences in the heavy-chain variable region of antibody 2B8 with potential human MHC class II binding activity are shown in Table 30.

TABLE 30

| | | | |
|---|---|---|---|
| VQLQQPGAELVKA, (SEQ ID NO: 1791) | LQQPGAELVKAGA, (SEQ ID NO: 1792) | AELVKAGASVKMS, (SEQ ID NO: 1793) | ELVKAGASVKMSC, (SEQ ID NO: 1794) |
| ASVKMSCKASGYT, (SEQ ID NO: 1795) | VKMSCKASGYTFT, (SEQ ID NO: 1796) | KMSCKASGYTFTS, (SEQ ID NO: 1797) | ASGYTFTSYNMHW, (SEQ ID NO: 1798) |
| SGYTFTSYNMHWV, (SEQ ID NO: 1799) | YTFTSYNMHWVKQ, (SEQ ID NO: 1800) | TSYNMHWVKQTPG, (SEQ ID NO: 1801) | YNMHWVKQTPGRG, (SEQ ID NO: 1802) |
| MHWVKQTPGRGLE, (SEQ ID NO: 1803) | HWVKQTPGRGLEW, (SEQ ID NO: 1804) | TPGRGLEWIGAIY, (SEQ ID NO: 1805) | RGLEWIGAIYPGN, (SEQ ID NO: 1806) |
| GLEWIGAIYPGNG, (SEQ ID NO: 1807) | EWIGAIYPGNGDT, (SEQ ID NO: 1808) | GAIYPGNGDTSYN, (SEQ ID NO: 1809) | AIYPGNGDTSYNQ, (SEQ ID NO: 1810) |
| YPGNGDTSYNQKF, (SEQ ID NO: 1811) | TSYNQKFKGKATL, (SEQ ID NO: 1812) | YNQKFKGKATLTA, (SEQ ID NO: 1813) | QKFKGKATLTADK, (SEQ ID NO: 1814) |
| ATLTADKSSSTAY, (SEQ ID NO: 1815) | TAYMQLSSLTSED, (SEQ ID NO: 1816) | AYMQLSSLTSEDS, (SEQ ID NO: 1817) | MQLSSLTSEDSAV, (SEQ ID NO: 1818) |
| SSLTSEDSAVYYC, (SEQ ID NO: 1819) | SLTSEDSAVYYCA, (SEQ ID NO: 1820) | TSEDSAVYYCARS, (SEQ ID NO: 1821) | SAVYYCARSTYYG, (SEQ ID NO: 1822) |
| AVYYCARSTYYGG, (SEQ ID NO: 1823) | VYYCARSTYYGGD, (SEQ ID NO: 1824) | STYYGGDTYFNVW, (SEQ ID NO: 1825) | TYYGGDTYFNVWG, (SEQ ID NO: 1826) |
| DTYFNVWGAGTTV, (SEQ ID NO: 1827) | TYFNVWGAGTTVT, (SEQ ID NO: 1828) | FNVWGAGTTVTVS, (SEQ ID NO: 1829) | NVWGAGTTVTVSA. (SEQ ID NO: 1830) |

Peptide sequences in the light-chain variable region of antibody 2B8 with potential human MHC class II binding activity are shown in Table 31.

TABLE 31

| | | | |
|---|---|---|---|
| QIVLSQSPAILSA, (SEQ ID NO: 1831) | IVLSQSPAILSAS, (SEQ ID NO: 1832) | QSPAILSASPGEK, (SEQ ID NO: 1833) | PAILSASPGEKVT, (SEQ ID NO: 1834) |
| AILSASPGEKVTM, (SEQ ID NO: 1835) | EKVTMTCRASSSV, (SEQ ID NO: 1836) | VTMTCRASSSVSY, (SEQ ID NO: 1837) | TMTCRASSSVSYI, (SEQ ID NO: 1838) |
| SSVSYIHWFQQKP, (SEQ ID NO: 1839) | VSYIHWFQQKPGS, (SEQ ID NO: 1840) | SYIHWFQQKPGSS, (SEQ ID NO: 1841) | IHWFQQKPGSSPK, (SEQ ID NO: 1842) |
| KPWIYATSNLASG, (SEQ ID NO: 1843) | PWIYATSNLASGV, (SEQ ID NO: 1844) | WIYATSNLASGVP, (SEQ ID NO: 1845) | ATSNLASGVPVRF, (SEQ ID NO: 1846) |
| SNLASGVPVRFSG, (SEQ ID NO: 1847) | SGVPVRFSGSGSG, (SEQ ID NO: 1848) | VPVRFSGSGSGTS, (SEQ ID NO: 1849) | VRFSGSGSGTSYS, (SEQ ID NO: 1850) |
| GTSYSLTISRVEA, (SEQ ID NO: 1851) | TSYSLTISRVEAE, (SEQ ID NO: 1852) | SYSLTISRVEAED, (SEQ ID NO: 1853) | YSLTISRVEAEDA, (SEQ ID NO: 1854) |

TABLE 31-continued

| | | | |
|---|---|---|---|
| LTISRVEAEDAAT, (SEQ ID NO: 1855) | SRVEAEDAATYYC, (SEQ ID NO: 1856) | RVEAEDAATYYCQ, (SEQ ID NO: 1857) | ATYYCQQWTSNPP, (SEQ ID NO: 1858) |
| TYYCQQWTSNPPT, (SEQ ID NO: 1859) | QQWTSNPPTFGGG, (SEQ ID NO: 1860) | NPPTFGGGTKLEI (SEQ ID NO: 1861) | |

EXAMPLE 20

The present invention provides for modified forms of a monoclonal antibody with binding specificity to the human IL-2 receptor. The monoclonal antibody is designated anti-Tac and the modified form has one or more T cell epitopes removed. The anti-Tac antibody binds with high specificity to the alpha subunit (p55-alpha, CD25 or Tac) of the human high affinity IL-2 receptor expressed on the surface of T and B lymphocytes. Antibody binding blocks the ability of IL-2 to bind the receptor and achieve T-cell activation. The ability of the anti-Tac antibody to act as an IL-2 antagonist has significant clinical potential in the treatment of organ transplant rejection. Clinical studies using the mouse antibody have shown some initial benefit to patients who have undergone kidney transplant although the long term benefit over conventional immune suppression was not found due the development of a HAMA response in a high proportion of patients [Kirkham, R. L. et al (1991) Transplantation 51: 107-113]. A "humanized" anti-Tac antibody has been developed in which significant components of the protein have been engineered to contain protein sequence identified from a human antibody gene [Queen, C. et al (1989) Proc. Natl. Acad. Sci. (USA) 86: 10029-10033; U.S. Pat. Nos. 5,530,101; 5,585,089; 6,013,256]. The "humanised" anti-Tac (Zenapax™ or daclizumab) has undergone clinical trials as an immune suppressive agent for the management of acute graft versus host disease and suppression of kidney transplant rejection [Anasetti, C. et al (1994), Blood 84: 1320-1327; Anasetti, C. et al (1995) Blood 86: Supplement 1:62a; Eckhoff, D. E. et al (2000) Transplantation 69: 1867-1872; Ekberg, H. et al (1999) Transplant Proc. 31: 267-268].

Peptide sequences in the heavy-chain variable region of mouse anti-Tac antibody with potential human MHC class II binding activity are shown in Table 32.

TABLE 32

| | | | |
|---|---|---|---|
| VQLQQSGAELAKP, (SEQ ID NO: 1862) | AELAKPGASVKMS, (SEQ ID NO: 1863) | ASVKMSCKASGYT, (SEQ ID NO: 1864) | VKMSCKASGYTFT, (SEQ ID NO: 1865) |
| KMSCKASGYTFTS, (SEQ ID NO: 1866) | ASGYTFTSYRMHW, (SEQ ID NO: 1867) | SGYTFTSYRMHWV, (SEQ ID NO: 1868) | YTFTSYRMHWVKQ, (SEQ ID NO: 1869) |
| TSYRMHWVKQRPG, (SEQ ID NO: 1870) | YRMHWVKQRPGQG, (SEQ ID NO: 1871) | MHWVKQRPGQGLE, (SEQ ID NO: 1872) | HWVKQRPGQGLEW, (SEQ ID NO: 1873) |
| RPGQGLEWIGYIN, (SEQ ID NO: 1874) | QGLEWIGYINPST, (SEQ ID NO: 1875) | LEWIGYINPSTGY, (SEQ ID NO: 1876) | EWIGYINPSTGYT, (SEQ ID NO: 1877) |
| IGYINPSTGYTEY, (SEQ ID NO: 1878) | GYINPSTGYTEYN, (SEQ ID NO: 1879) | TGYTEYNQKFKDK, (SEQ ID NO: 1880) | TEYNQKFKDKATL, (SEQ ID NO: 1881) |
| QKFKDKATLTADK, (SEQ ID NO: 1882) | ATLTADKSSSTAY, (SEQ ID NO: 1883) | TAYMQLSSLTFED, (SEQ ID NO: 1884) | AYMQLSSLTFEDS, (SEQ ID NO: 1885) |
| YMQLSSLTFEDSA, (SEQ ID NO: 1886) | MQLSSLTFEDSAV, (SEQ ID NO: 1887) | SSLTFEDSAVYYC, (SEQ ID NO: 1888) | SLTFEDSAVYYCA, (SEQ ID NO: 1889) |
| LTFEDSAVYYCAR, (SEQ ID NO: 1890) | SAVYYCARGGGVF, (SEQ ID NO: 1891) | AVYYCARGGGVFD, (SEQ ID NO: 1892) | VYYCARGGGVFDY, (SEQ ID NO: 1893) |
| GGVFDYWGQGTTL, (SEQ ID NO: 1894) | GVFDYWGQGTTLT, (SEQ ID NO: 1895) | FDYWGQGTTLTVS, (SEQ ID NO: 1896) | DYWGQGTTLTVSS. (SEQ ID NO: 1897) |

Peptide sequences in the light-chain variable region of mouse anti-Tac antibody with potential human MHC class II binding activity are shown in Table 33.

TABLE 33

| | | | |
|---|---|---|---|
| QIVLTQSPAIMSA, (SEQ ID NO: 1898) | IVLTQSPAIMSAS, (SEQ ID NO: 1899) | QSPAIMSASPGEK, (SEQ ID NO: 1900) | PAIMSASPGEKVT, (SEQ ID NO: 1901) |
| AIMSASPGEKVTI, (SEQ ID NO: 1902) | EKVTITCSASSSI, (SEQ ID NO: 1903) | VTITCSASSSISY, (SEQ ID NO: 1904) | TITCSASSSISYM, (SEQ ID NO: 1905) |

TABLE 33-continued

| | | | |
|---|---|---|---|
| SSISYNHWFQQKP, (SEQ ID NO: 1906) | ISYMHWFQQKPGT, (SEQ ID NO: 1907) | SYMHWFQQKPGTS, (SEQ ID NO: 1908) | MHWFQQKPGTSPK, (SEQ ID NO: 1909) |
| HWFQQKPGTSPKL, (SEQ ID NO: 1910) | SPKLWIYTTSNLA, (SEQ ID NO: 1911) | PKLWIYTTSNLAS, (SEQ ID NO: 1912) | KLWIYTTSNLASG, (SEQ ID NO: 1913) |
| LWIYTTSNLASGV, (SEQ ID NO: 1914) | WIYTTSNLASGVP, (SEQ ID NO: 1915) | TTSNLASGVPARF, (SEQ ID NO: 1916) | SNLASGVPARFSG, (SEQ ID NO: 1917) |
| SGVPARFSGSGSG, (SEQ ID NO: 1918) | ARFSGSGSGTSYS, (SEQ ID NO: 1919) | GTSYSLTISRMEA, (SEQ ID NO: 1920) | TSYSLTISRMEAE, (SEQ ID NO: 1921) |
| SYSLTISRMEAED, (SEQ ID NO: 1922) | YSLTISRMEAEDA, (SEQ ID NO: 1923) | LTISRMEAEDAAT, (SEQ ID NO: 1924) | SRMEAEDAATYYC, (SEQ ID NO: 1925) |
| ATYYCHQRSTYPL, (SEQ ID NO: 1926) | TYYCHQRSTYPLT, (SEQ ID NO: 1927) | STYPLTFGSGTKL, (SEQ ID NO: 1928) | TYPLTFGSGTKLE, (SEQ ID NO: 1929) |
| YPLTFGSGTKLEL. (SEQ ID NO: 1930) | | | |

Peptide sequences in the heavy-chain variable region of humanized anti-Tac antibody with potential human MHC class II binding activity are shown in Table 34.

TABLE 34

| | | | |
|---|---|---|---|
| VQLVQSGAEVKKP, (SEQ ID NO: 1931) | QLVQSGAEVKKPG, (SEQ ID NO: 1932) | AEVKKPGSSVKVS, (SEQ ID NO: 1933) | SSVKVSCKASGYT, (SEQ ID NO: 1934) |
| VKVSCKASGYTFT, (SEQ ID NO: 1935) | KVSCKASGYTFTS, (SEQ ID NO: 1936) | ASGYTFTSYRMHW, (SEQ ID NO: 1937) | SGYTFTSYRMHWV, (SEQ ID NO: 1938) |
| YTFTSYRMHWVRQ, (SEQ ID NO: 1939) | TSYRMHWVRQAPG, (SEQ ID NO: 1940) | YRMHWVRQAPGQG, (SEQ ID NO: 1941) | MHWVRQAPGQGLE, (SEQ ID NO: 1942) |
| HWVRQAPGQGLEW, (SEQ ID NO: 1943) | RQAPGQGLEWIGY, (SEQ ID NO: 1944) | APGQGLEWIGYIN, (SEQ ID NO: 1945) | QGLEWIGYINPST, (SEQ ID NO: 1946) |
| LEWIGYINPSTGY, (SEQ ID NO: 1947) | EWIGYINPSTGYT, (SEQ ID NO: 1948) | WIGYINPSTGYTE, (SEQ ID NO: 1949) | IGYINPSTGYTEY, (SEQ ID NO: 1950) |
| GYINPSTGYTEYN, (SEQ ID NO: 1951) | TGYTEYNQKFKDK, (SEQ ID NO: 1952) | TEYNQKFKDKATI, (SEQ ID NO: 1953) | QKFKDKATITADE, (SEQ ID NO: 1954) |
| ATITADESTNTAY, (SEQ ID NO: 1955) | TITADESTNTAYM, (SEQ ID NO: 1956) | TNTAYMELSSLRS, (SEQ ID NO: 1957) | TAYMELSSLRSED, (SEQ ID NO: 1958) |
| AYMELSSLRSEDT, (SEQ ID NO: 1959) | MELSSLRSEDTAV, (SEQ ID NO: 1960) | SSLRSEDTAVYYC, (SEQ ID NO: 1961) | SLRSEDTAVYYCA, (SEQ ID NO: 1962) |
| RSEDTAVYYCARG, (SEQ ID NO: 1963) | TAVYYCARGGGVF, (SEQ ID NO: 1964) | AVYYCARGGGVFD, (SEQ ID NO: 1965) | VYYCARGGGVFDY, (SEQ ID NO: 1966) |
| GGVFDYWGQGTLV, (SEQ ID NO: 1967) | GVFDYWGQGTLVT, (SEQ ID NO: 1968) | FDYWGQGTLVTVS, (SEQ ID NO: 1969) | DYWGQGTLVTVSS. (SEQ ID NO: 1970) |

Peptide sequences in the light-chain variable region of humanized anti-Tac antibody with potential human MHC class II binding activity are shown in Table 35.

TABLE 35

| | | | |
|---|---|---|---|
| IQMTQSPSTLSAS, (SEQ ID NO: 1971) | STLSASVGDRVTI, (SEQ ID NO: 1972) | ASVGDRVTITCSA, (SEQ ID NO: 1973) | DRVTITCSASSSI, (SEQ ID NO: 1974) |
| VTITCSASSSISY, (SEQ ID NO: 1975) | TITCSASSSISYM, (SEQ ID NO: 1976) | SSISYMHWYQQKP, (SEQ ID NO: 1977) | ISYMHWYQQKPGK, (SEQ ID NO: 1978) |
| SYMHWYQQKPGKA, (SEQ ID NO: 1979) | MHWYQQKPGKAPK, (SEQ ID NO: 1980) | HWYQQKPGKAPKL, (SEQ ID NO: 1981) | QKPGKAPKLLIYT, (SEQ ID NO: 1982) |
| PKLLIYTTSNLAS, (SEQ ID NO: 1983) | KLLIYTTSNLASG, (SEQ ID NO: 1984) | LLIYTTSNLASGV, (SEQ ID NO: 1985) | LIYTTSNLASGVP, (SEQ ID NO: 1986) |
| TTSNLASGVPARF, (SEQ ID NO: 1987) | SNLASGVPARFSG, (SEQ ID NO: 1988) | SGVPARFSGSGSG, (SEQ ID NO: 1989) | ARFSGSGSGTEFT, (SEQ ID NO: 1990) |
| SGSGTEFTLTISS, (SEQ ID NO: 1991) | GTEFTLTISSLQP, (SEQ ID NO: 1992) | TEFTLTISSLQPD, (SEQ ID NO: 1993) | FTLTISSLQPDDF, (SEQ ID NO: 1994) |
| LTISSLQPDDFAT, (SEQ ID NO: 1995) | TISSLQPDDFATY, (SEQ ID NO: 1996) | SSLQPDDFATYYC, (SEQ ID NO: 1997) | SLQPDDFATYYCH, (SEQ ID NO: 1998) |
| DDFATYYCHQRST, (SEQ ID NO: 1999) | ATYYCHQRSTYPL, (SEQ ID NO: 2000) | TYYCHQRSTYPLT, (SEQ ID NO: 2001) | STYPLTFGQGTKV, (SEQ ID NO: 2002) |
| TYPLTFGQGTKVE, (SEQ ID NO: 2003) | YPLTFGQGTKVEV. (SEQ ID NO: 2004) | | |

EXAMPLE 21

(14.18 Antibody)

Unless stated otherwise all amino acids in the variable heavy and light chains are numbered as in Kabat et al., 1991 (Sequences of Proteins of Immunological Interest, US Department of Health and Human Services). Potential T-cell epitopes are numbered with the linear number of the first amino acid of an epitope, counting from the first amino acid of the heavy and light chains.

1 Comparison with Mouse Subgroup Frameworks

The amino acid sequences of murine 14.18 VH and VK were compared to consensus sequences for the Kabat murine heavy and light chain subgroups (Kabat et al., 1991). 14.18 VH can be assigned to Mouse Heavy Chains Subgroup II(A). The sequence of 14.18VH is shown in SEQ ID NO: 2015. The comparison with the consensus sequence of this subgroup shows that the histidine at position 81 (normally glutamine), the lysine at position 82a (normally seine or asparagine), the valine at position 93 (normally alanine) and the seine at position 94 (normally arginine) are atypical for this subgroup. The residues at positions 19, 40 and 66 are also found infrequently in this subgroup, but are considered to have minor effects on antibody binding and structure. 14.18 VK (SEQ ID NO: 2016) can be assigned to Mouse Kappa Chains Subgroup II. The comparison to the consensus sequence for this subgroup shows that the histidine at position 49 is atypical for this subgroup. This residue is most commonly tyrosine.

2 Comparison with Human Frameworks

The amino acid sequences of murine 14.18 $V_H$ and $V_K$ were compared to the sequences of the directories of human germline $V_H$ (Tomlinson et al., J. Mol. Biol. 1992: 227, 776-798) and VK (Cox et. al. (Eur. J. Immunol. 1994; 1-4-. 827-36)) sequences and also to human germline J region sequences (Routledge et al., In "Protein Engineering of Antibody Molecules for Prophylactic and Therapeutic Applications in Man". Clark M ed. Academic Titles, Nottingham pp. 13-44, 1993). The reference human framework selected for 14.18 $V_H$ was DP25 with human $J_H6$. This germline sequence has been found in a rearranged mature antibody gene with no amino acid changes. For framework 3 the sequence of the mature human antibody 29 was used. This sequence is identical to the murine sequence immediately adjacent to CDR3. The reference human framework selected for 14.18 VK was DPK22. This germline sequence has been found in a rearranged mature antibody gene with no amino acid changes. For framework 2 the sequence of the mature human antibody 163.5 was used. This sequence is identical to the murine sequence immediately adjacent to CDR2. The J region sequence was human JK2 (Routledge et al., 1993).

3 Design of Veneered Sequences

Following identification of the reference human framework sequences, certain non-identical amino acid residues within the 14.18 $V_H$ and $V_K$ frameworks were changed to the corresponding amino acid in the human reference sequence. Residues which are considered to be critical for antibody structure and binding were excluded from this process and not altered. The murine residues that were retained at this stage are largely non-surface, buried residues, apart from residues at the N-terminus for instance, which are close to the CDRs in the final antibody. This process produces a sequence that is broadly similar to a "veneered" antibody as the surface residues are mainly human and the buried residues are as in the original murine sequence.

4 Peptide Threading Analysis

The murine and veneered 14.18 $V_H$ and $V_K$ sequences were analyzed using the method according to the invention. The amino acid sequences are divided into all possible 13-mers. The 13-mer peptides are sequentially presented to the models of the binding groove of the HLA-DR allotypes and a binding score assigned to each peptide for each allele. A conformational score is calculated for each pocket-bound side chain of the peptide. This score is based on steric overlap, potential hydrogen bonds between peptide and residues in the binding groove, electrostatic interactions and favorable contacts between peptide and pocket residues. The conformation of each side chain is then altered and the score recalculated. Having determined the highest conformational score, the binding score is then calculated based on the groove-bound hydrophobic residues, the non-groove hydrophilic residues and the number of residues that fit into the binding groove. Known binders to NMC class II achieve a significant binding score with almost no false negatives. Thus peptides achieving a significant binding score from the current analysis are considered to be potential T-cell epitopes. The results of the peptide threading analysis for the murine and veneered sequences are shown in Table 36.

TABLE 36

Potential T-cell epitopes in murine and veneered 14.18 sequences

| Sequence | Number of potential T-cell | Location of potential epitopes |
|---|---|---|
| Murine 14, 18 VH | 11 | 3(17), 9(15), 30(5), 35(17), 39(15), 43(9), 58(12), 62(11), 81(11), 84(16), 101(7) |
| Veneered 14.18 VH | 5 | 43(9), 58(12), 62(11), 81(11), 84(16) |
| Murine 14.18 VK | 7 | 7(7), 13(11), 27(15), 49(11), 86(17), 97(11), 100(4) |
| Veneered 14.18 VK | 5 | 27(I5), 49(11), 86(17), 97(11), 100(17) |

5 Removal of Potential T Cell Epitopes

Potential T-cell epitopes are removed by making amino acid substitutions in the particular peptide that constitutes the epitope. Substitutions were made by inserting amino acids of similar physicochemical properties if possible. However in order to remove some potential epitopes, amino acids of different size, charge or hydrophobicity may need to be substituted. IT changes have to made within CDRs which might have an effect on binding, it is necessary to make a variant with and without the particular amino acid substitution. The linear number for amino acid residues for substitution is given with the Kabat number in brackets. Potential T Cell epitopes are referred to by the linear number of the first residue of the 13-mer.

The amino acid changes required to remove T-cell epitopes from the veneered 14.18 heavy chain variable region were as follows:

1 Substitution of isoleucine for proline at residue 41 (Kabat number 41), combined with substituting leucine for alanine at residue 50 in CDR2 removes the potential epitope at position 43.
2 An alternative to (1), substitution of threonine for leucine at residue 45 (Kabat number 45) with proline at position 41 (Kabat number 41) also removes the potential epitope at position 43.
3 Substitution of serine for glycine at residue 66 (Kabat number 65) in CDR2 and valine for alanine at residue 68 (Kabat number 67) removes the potential epitope at position 58. Seine is found at this position in human and mouse antibody sequences.
4 Substitution of isoleucine for leucine at residue 70 (Kabat: 69) reduces the number of MHC allotypes that bind to the potential epitope at position 62 from 11 to 4.
5 Substitution of alanine for valine position 72 (Kabat number 71) removes the potential epitope position 62. The size of the amino acid at this position is critical and alanine is similar in size and hydrophobicity to valine.
6. Substitution of threonine for serine at residue 91 (Kabat number 87) removes the potential epitopes at positions 81 and 84.

The amino acid substitutions required to remove the potential T-cell epitopes from the veneered 14.18 light chain variable region were as follows:

1. Substitution of seine for arginine at residue 32 (Kabat number 27e) removes the potential epitope at position 27. This residue is within CDR2, however seine is often found at tWs position in mouse and human antibodies. There is no change outward the CDR which removes this potential T-cell epitope.
2. Substitution of tyrosine for histidine at position 54 (Kabat number 49) eliminates the potential epitope at position 43. Tyrosine is the most frequent amino acid found at position 49 in mouse and human antibodies.
3. An alternative change to (2) for elimination of the potential epitope at position 43, is substitution of methionine for leucine at residue 51 (Kabat number 46). Methionine is similar to leucine in size and hydrophobicity.
4. Substitution of methionine for leucine at residue 88 (Kabat number 83) removes the potential epitope at position 86.
5. Substitution of threonine for leucine at residue 102 (Kabat number 96) in CDRH3, when combined with glutamine to glycine at position 105 (Kabat number 100) reduces the number of MHC allotypes that bind to the potential epitope at position 97 from 11 to 5.
6. An alternative change to (5) which eliminates the potential epitope at position 97 is substitution of proline for leucine at residue 102 (Kabat number 96).
7. Substitution of valine for leucine at residue 110 (Kabat number 104) removes the potential epitope at position 100.

6 Design of De-immunized Sequences

De-immunized heavy and light chain sequences were designed with reference to the changes required to remove potential T-cell epitopes and consideration of framework residues that might be critical for antibody structure and binding. In addition to the De-immunized sequences based on the veneered sequence, an additional sequence was designed for each VH and VK based on the murine sequence, termed the Mouse Peptide Threaded (MoPT) version. For this version, changes were made directly to the murine sequence in order to eliminate T-cell epitopes, but only changes outside the CDRs that are not considered to be detrimental to binding are made. No attempt to remove surface (B cell) epitopes has been made in this version of the de-immunized sequence.

The primary de-immunized VH includes substitutions 1, 3, 4, 5, and 6 in Section 5 above and includes no potential T-cell epitopes. A further 4 de-immunized VHS were designed in order to test the effect of the various substitutions required on antibody binding. Version 2 is an alternative to Version 1 in which an alternative substitution (2 in Section 2.5 above) has been used to remove the same potential T-cell epitope. The cumulative alterations made to the primary de-immunized sequence (14.18DIVH1) and the potential T-cell epitopes remaining are detailed in Table 37. The mouse threaded version is included for comparison.

Table 37: Amino acid changes and potential epitopes in de-immunized 14.18 VH

TABLE 37

| Variant | Cumulative residue changes | Potential epitopes (no. of potential MHC binders from 18 tested) |
|---|---|---|
| 14.18DIVH1 | None | None |
| 14.18DIVH2 | 41I → P, 45L → T, 50L → A | None |
| 14.18DIVH3 | 65S → G | 58(8) |
| 14.18DIVH4 | 71A → V | 58(8), 62(4) |

TABLE 37-continued

| Variant | Cumulative residue changes | Potential epitopes (no. of potential MHC binders from 18 tested) |
|---|---|---|
| 14.18DIVH5 | 45T → L, 41P → 1 | 43(9) 58(8) 62(4) |
| 14.18MoPTVH | NA | 43(9) 58(12) 62(11) |

The primary de-immunized VK includes substitutions 1, 2, 4, 6 and 7 in Section 5 above. The primary de-immunized VK includes no potential T-cell epitopes. A further 5 De-immunized VKS were designed in order to test the effect of the various substitutions required on antibody binding. Version 2 is an alternative to Version 1 in which a different substitution has been used to remove the potential T-cell epitope at position 43. Versions 3 includes the alternative substitution (6 in Section 2.5 above), which reduces the number of MHC allotypes that bind to the potential epitope at position 97 from 11 to 5. The cumulative alterations made to the primary De-immunized sequence (14.18DIVK1) and the potential T-cell epitopes remaining are detailed in Table 38.

TABLE 38

Amino acid changes and potential epitopes in de-immunized 14.18 VK

| | Cumulative residue changes* | Potential epitopes' (no. of potential MHC binders from 18 tested) |
|---|---|---|
| 14.18DIVKI | None | None |
| 14.18DIVK2 | 46L → M, 49Y → H | None |
| 14.18DIVK3 | 96P → T, 100Q → G | 97(5) |
| 14.18DIVK4 | 96T → L | 97(11) |
| 14.18DIVK5 | 27e S → R | 27(15), 97(11) |
| 14.18DIVK6 | 46M → L | 27(15), 49(11), 97(11) |
| 14.18MoPTVK | NA | 27(15), 49(11), 97(11), 100(4) |

Sequences of versions of modified epitopes:

```
14.18 VH veneered: (SEQ ID NO: 2005):
EVQLLQSGPELKKPGASVKISCKASGSSFTGYNMNWVRQAPGQRLEWIGAIDPYYGGTSYNQKFKGRAT

LSVDKSSSQAYMHLKSLTSEDSAVYYCVSGMEYWGQGTTVTVSS 14.18 VK veneered: (SEQ ID NO: 2006):
DVVMTQSPGTLPVSLGERATISCRSSQSLVHRNGNTYLHWYLQKPGQSPKLLIHKVSNRFSGVPDRFSG

SGSGTDFTLTISRLEAEDLAVYFCSQSTHVPPLTFGQGTKLEIK 14.18 de-immunized VH1 (SEQ ID NO: 2007):
EVQLLQSGPELKKPGASVKISCKASGSSFTGYNMNWVRQAIGQRLEWIGLIDPYYGGTSYNQKFKSRVT

ITADKSSSQAYMHLKSLTSEDTAVYYCVSGMEYWGQGTTVTVSS 14.18 de-immunized VK1 (SEQ ID NO: 2008):
DVVMTQSPGTLPVSLGERATISCRSSQSLVHSNGNTYLHWYLQKPGQSPKLLIYKVSNRFSGVPDRFSG

SGSGTDFTLTISRLEAEDMAVYFCSQSTHVPPPTFGQGTKVEIK 14.18 de-immunized VH2 (SEQ ID NO: 2009):
EVQLLQSGPELKKPGASVKISCKASGSSFTGYNMNWVRQAPGQRTEWIGAIDPYYGGTSYNQKFKSRVT

ITADKSSSQAYMHLKSLTSEDTAVYYCVSGMEYWGQGTTVTVSS 14.18 de-immimized VK2 (SEQ ID NO: 2010):
DVVMTQSPGTLPVSLGERATISCRSSQSLVHSNGNTYLHWYLQKPGQSPKMLIHKVSNRFSGVPDRFSG

SGSGTDFTLTISRLEAEDMAVYFCSQSTHVPPPTFGQGTKVEIK 14.18 de-immunized VH3 (SEQ ID NO: 2011):
EVQLLQSGPELKKPGASVKISCKASGSSFTGYNMNWVRQAPGQRTEWIGAIDPYYGGTSYNQKFKGRVT

ITADKSSSQAYMHLKSLTSEDTAVYYCVSGMEYWGQGTTVTVSS 14.18 de-immunized VK3 (SEQ ID NO: 2012):
DVVMTQSPGTLPVSLGERATISCRSSQSLVHSNGNTYLHWYLQKPGQSPKMLIHKVSNRFSGVPDRFSG

SGSGTDFTLTISPLEAEDMAVYFCSQSTHVPPTTFGGGTKVEIK 14.18 de-immunized VH4 (SEQ ID NO: 2013):
EVQLLQSGPELKKPGASVKISCKASGSSFTGYNMNWVRQAPGQRTEWIGAIDPYYGGTSYNQKFKGRVT

ITVDKSSSQAYMHLKSLTSEDTAVYYCVSGMEYWGQGTTVTVSS 14.18 de-immunized VK4 (SEQ ID NO: 2014):
DVVMTQSPGTLPVSLGERATISCRSSQSLVHSNGNTYLHWYLQKPGQSPKMLIHKVSNRFSGVPDRFSG

SGSGTDFTLTISRLEAEDMAVYFCSQSTHVPPLTFGGGTKVEIK 14.18 de-immunized VH5 (SEQ ID NO: 2015):
EVQLLQSGPELKKPGASVKISCKASGSSFTGYNMNWVRQAIGQRLEWIGAIDPYYGGTSYNQKFKGRVT
```

-continued
ITVDKSSSQAYMHLKSLTSEDTAVYYCVSGMEYWGQGTTVTVSS 14.18 de-immunized VK5 (SEQ ID NO: 2016):
DVVMTQSPGTLPVSLGERATISCRSSQSLVHRNGNTYLHWYLQKPGQSPKMLIHKVSNRFSGVPDRFSG

SGSGTDFTLTISRLEAEDMAVYFCSQSTHVPPLTFGGGTKVEIK 14.18 VH mouse, peptide threaded (Mo PT) (SEQ ID NO: 2017):
EVQLVQSGPEVEKPSASVKISCKASGSSFTGYNMNWVRQAIGKSLEWIGAIDPYYGGTSYNQKFKGRAT

LTVDKSSTAYMHLKSLTSEDTAVYYCVSGMEYWGQGTTVTVSS 14.18 VK mouse, peptide threaded (Mo PT) (SEQ ID NO: 2018):
DVVMTQTPGSLPVSAGDQASISCRSSQSLVHRNGNTYLHWYLQKPGQSPKLLIHKVSNRFSGVPDRFSG

SGSGTDFTLKISRVEAEDSGVYFCSQSTHVPPLTFGAGTKLELK 14.18 VH mouse (SEQ ID NO: 2019):
EVQLLQSGPELEKPSASVMISCKASGSSFTGYNMNWVRQNIGKSLEWIGAIDPYYGGTSYNQKFKGRAT

LTVDKSSSTAYMHLKSLTSEDSAVYYCVSGMEYWGQGTSVTVSS 14.18 VK mouse (SEQ ID NO: 2020):
DVVMTQTPLSLPVSLGDQASISCRSSQSLVHRNGNTYLHWYLQKPGQSPKLLIHKVSNRFSGVPDRFSG

SGSGTDFTLKISRVEAEDLGVYFCSQSTHVPPLTFGAGTKLELK

EXAMPLE 22

(KS Antibody)

1 Comparison with Mouse Subgroup Frameworks

Figure 2:
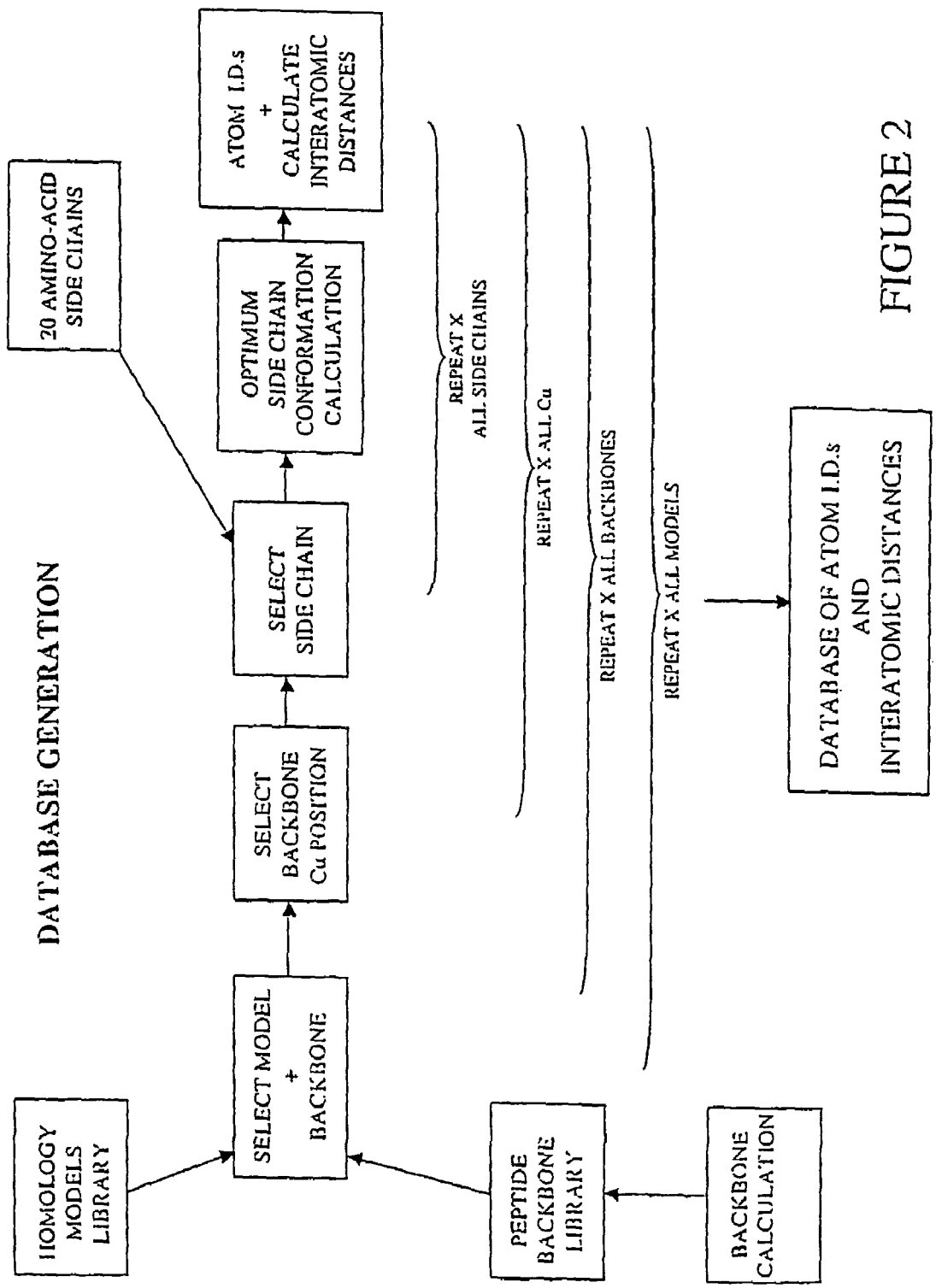
FIG. 2 is a flow chart illustrating a database generation for a computational method embodying the present invention.

The amino acid sequences of murine KS VH and VK were compared to consensus sequences for the Kabat murine heavy and light chain subgroups (Kabat et al., 1991). Murine KS VH cannot be assigned to any one Subgroup, but is closest to Subgroup II(A) and V(A). Unusual residues are found at position 2 which is normally valine, 46 which is normally glutamic acid, and 68 which is normally threonine. Residue 69 is more commonly leucine or iso-leucine. At 82b, serine is most often found. Murine KS VK can be assigned to Subgroup VI (FIG. 2). Unusual residues are found at 46 and 47 which are commonly both leucine. Residue 58 is unusual with either leucine or valine normally found at this position.

2 Comparison with Human Frameworks

The amino acid sequences of murine KS VH and VK were compared to the sequences of the directory of human germline VH (Tomlinson et al., 1992) and VK (COX et al. 1994) sequences and also to human germline J region sequences (Routledge et al., 1993). The reference human framework selected for KS VH was DP10 with human JH6. This germline sequence has been found in a rearranged mature antibody gene with no amino acid changes. The reference human framework selected for KS VK was B1. For framework-2 the sequence of the mature human antibody IMEV was used (in Kabat et al 1991). This sequence is identical to the murine sequence immediately adjacent to CDR2. The J region sequence was human JK4. This germline sequence has not been found as rearranged mature antibody light chain.

3 Design of Veneered Sequences

Following identification of the reference human framework sequences, certain non-identical amino acid residues within the 425 VH and VK frameworks were changed to the corresponding amino acid in the human reference sequence. Residues which are considered to be critical for antibody structure and bindin2 were excluded from this process and not altered. The murine residues that were retained at this stage are largely non-surface, buried residues, apart from residues at the N-terminus for instance, which are close to the CDRs in the final antibody. This process produces a sequence that is broadly similar to a "veneered" antibody as the surface residues are mainly human and the buried residues are as in the original murine sequence.

4 Peptide Threading Analysis

The murine and veneered KS VH and VK sequences were analyzed using the method according to the invention. The amino acid sequences are divided into all possible 13imers. The 13-mer peptides are sequentially presented to the models of the binding groove of the HLA-DR allotypes and a binding score assigned to each peptide for each allele. A conformational score is calculated for each pocket-bound side chain of the peptide. This score is based on steric overlap, potential hydrogen bonds between peptide and residues in the binding groove, electrostatic interactions and favorable contacts between peptide and pocket residues. The conformation of each side chain is then altered and the score recalculated. Having determined the highest conformational score, the binding score is then calculated based on the (groove-bound hydrophobic residues, the non-groove hydrophilic residues and the number of residues that fit into the binding groove. Known binders to MHC class II achieve a significant binding score with almost no false negatives. Thus peptides achieving, a significant binding score from the current analysis are considered to be potential T cell epitopes. The results of the peptide threading analysis for the murine and veneered sequences are shown in Table 39.

TABLE 39

Potential T cell epitopes in murine and veneered KS sequences

| Sequence | Number of potential T cell epitopes | Location of potential epitopes (no. of potential MHC binders) |
|---|---|---|
| Murine KS VH | 6 | 35(11), 62(17), 78(12), 81(12), 89(6), 98(15) |
| Murine KS VH | 5 | 30(7), 62(15), 78(11), 89(6), 98(15) |
| Murine KS VK | 6 | 1(14), 2(5), 17(5), 27(5), 51(13), 72(18) |
| Veneered KS VK | 3 | 1(17), 27(5), 51(13) |

5 Removal of Potential T Cell Epitopes

Potential T cell epitopes are removed by making amino acid substitutions in the particular peptide that constitutes the epitope. Substitutions were made by inserting amino acids of similar physicochemical properties if possible. However in order to remove some potential epitopes, amino acids of different size, charge or hydrophobicity may need to be substituted. If changes have to made within CDRs which might have an effect on binding, there is then a need to make a variant with and without the particular amino acid substitution. Numbering of amino acid residues for substitution is as per Kabat. Potential T Cell epitopes are referred to by the linear number of the first residue of the 13mer.

The amino acid changes required to remove T cell epitopes from the veneered KS heavy chain variable region were as follows:

1. Substitution of arginine for lysine at residue 38 (Kabat number 38) removes the potential epitope at residue no 30.
2. Substitution of alanine for leucine at residue 72 (Kabat number 71) and isoleucine for phenylalanine at residue 70 (Kabat number 69) removes the potential epitope at residue 62. An isoleucine at Kabat number 69 and alanine at Kabat number 71 is found in a human germline VH sequence, DP10.
3. Substitution of leucine for alanine at residue 79 (Kabat number 78) removes the potential epitope at residue number 78.
4. Substitution of threonine for methionine at residue 91 (Kabat number 87), removes the potential epitope at residue number 89.
5. Substitution of methionine for at isoleucine residue 100 (Kabat number 96) in CDRH3 removes the potential epitope at residue 98. There is no change out with CDRH3 which removes this potential epitope.

The amino acid substitutions required to remove the potential T cell epitopes from the veneered KS light chain variable region were as follows:

1. Substitution of isoleucine for methionine at residue 32 (Kabat number 33) removes the potential epitope at residue number 27. This residue is within CDR2. Isoleucine is commonly found at this position in human antibodies.
2. The potential epitope at position 1 is removed by substituting valine for leucine at residue (Kabat number 3).
3. Substitution of seine for alanine at residue 59 (Kabat number 60) removes the potential epitope at residue number 51.

6 Design of De-immunized Sequences

De-immunized heavy and light chain sequences were designed with reference to the changes required to remove potential T cell epitopes and consideration of framework residues that might be critical for antibody structure and binding. In addition to the de-immunized sequences based on the veneered sequence, an additional sequence was designed for each VH, and VK based on the murine sequence, termed the Mouse Peptide Threaded (MoPT) version. For this version, changes. were made directly to the murine sequence in order to eliminate T cell epitopes, but only changes outside the CDRs that are not considered to be detrimental to binding are made. No attempt to remove surface (B cell) epitopes has been made in this version of the de-immunized sequence. The primary de-immunized VH includes substitutions 1 to 5 in Section 5 above and one extra change at residue 43 (Kabat number 43). Lysine found in the murine sequence was substituted for the glutamine from the human framework. Lysine is positively charged and therefore significantly different to glutamine; this region may be involved in VH/VL contacts. The primary de-immunized VH includes no potential T cell epitopes. A further 4 de-immunized VHs were designed in order to test the effect of the various substitutions required on antibody binding. The cumulative alterations made to the primary de-immunized sequence (KSDIVHv1) and the potential T cell epitopes remaining are detailed in Table 40.

TABLE 40

Amino acid changes and potential epitopes in de-immunized KS VH

| Variant | Cumulative residue changes | Potential epitopes (no. of potential MHC binders from 18 tested) |
|---|---|---|
| KSDIVHv1 | None | None |
| KSDIVHv2 | 96M → I | 98(15) |
| KSDIVHv3 | 71A → L, 78L → A | 62(16), 78(11), 98(15) |
| KSDIVHv4 | 38 R → K | 30(7), 62(16), 78(11), 98(15) |
| KSDIVHv5 | 68T → A, 69I → F | 30(7), 62(17), 78(11), 98(15) |
| KSMoPTVH | NA | 98(15), 78(12) |

The primary de-immunized VK includes substitutions 1 to 3 in Section 5 above. A further 3 de-immunized VKs were designed in order to test the effect of the various substitutions required on antibody binding. The cumulative alterations made to the primary de-immunized sequence (KSDIVKv1) and the potential T cell epitopes remaining are detailed in Table 41. Sequences of modified epitopes are shown in Table 42.

TABLE 41

Amino acid changes and potential epitopes in de-immunized KS VK

| Variant | Cumulative residue changes | Potential epitopes (no. of potential MHC binders from 18 tested) |
|---|---|---|
| KSDIVKv1 | None | None |
| KSDIVKv2 | 33I → M | 27(5) |
| KSDIVKv3 | 3V → L | 1(17), 27(5) |
| KSDIVKv4 | 60 S → A | 1(17), 27(5), 5(13) |
| KSMoPTVK | NA | None |

Table 42. Sequences of versions of modified epitopes.

KS VH veneered: (SEQ ID NO: 2021):
QIQLVQSGPELKKPGSSVKISCKASGYTFTNYGMNWVKQAPGQGLKWMGWINTYTGEPTYADDFKGRFT

FTLETSTSTAYLQLNNLRSEDMATYFCVRFISKGDYWGQGTTVTVSS

KS VK veneered: (SEQ ID NO: 2022):
QILLTQSPASLAVSPGQRATITCSASSSVSYMLWYQQKPGQPPKPWIFDTSNLASGFPARFSGSGSGTS

YTLTINSLEAEDAATYYCHQRSGYPYTFGGGTKVEIK

KS de-immnunized VH1 (SEQ ID NO: 2023):

-continued

QIQLVQSGPELKKPGSSVKISCKASGYTFTNYGMNWVRQAPGKGLKWMGWINTYTGEPTYADDFKGRFT

ITAETSTSTLYLQLNNLRSEDTATYFCVRFMSKGDYWGQGTTVTVSS

KS de-immunized VK1 (SEQ ID NO: 2024):
QIVLTQSPASLAVSPGQRATITCSASSSVSYILWYQQKPGQPPKPWIFDTSNLASGFPSRFSGSGSGTS

YTLTINSLEAEDAATYYCHQRSGYPYTFGGGTKVEIK

KS de-immunized VH2 (SEQ ID NO: 2025):
QIQLVQSGPELKKPGSSVKISCKASGYTFTNYGMNWVRQAPGKGLKWMGWINTYTGEPTYADDFKGRFT

ITAETSTSTLYLQLNNLRSEDTATYFCVRFISKGDYWGQGTTVTVSS

KS de-immunized VK2 (SEQ ID NO: 2026):
QIVLTQSPASLAVSPGQRATITCSASSSVSYMLWYQQKPGQPPKPWIFDTSNLASGFPSRFSGSGSGTS

YTLTINSLEAEDAATYYCHQRSGYPYTFGGGTKVEIK

KS de-immunized VH3 (SEQ ID NO: 2027):
QIQLVQSGPELKKPGSSVKISCKASGYTFTNYGMNWVRQAPGKGLKWMGWINTYTGEPTYADDFKGRFT

ITLETSTSTAYLQLNNLRSEDTATYFCVRFISKGDYWGQGTTVTVSS

KS de-immunized VK3 (SEQ ID NO: 2028):
QILLTQSPASLAVSPGQRATITCSASSSVSYMLWYQQKPGQPPKPWIFDTSNLASGFPSRFSGSGSGTS

YTLTINSLEAEDAATYYCHQRSGYPYTFGGGTKVEIK

KS de-immunized VH4 (SEQ ID NO: 2029):
QIQLVQSGPELKKPGSSVKISCKASGYTFTNYGMNWVKQAPGKGLKWMGWINTYTGEPTYADDFKGRFT

ITLETSTSTAYLQLNNLRSEDTATYFCVRFISKGDYWGQGTTVTVSS

KS de-immunized VK4 (SEQ ID NO: 2030):
QILLTQSPASLAVSPGQRATITCSASSSVSYMLWYQQKPGQPPKPWIFDTSNLASGFPARFSGSGSGTS

YTLTINSLEAEDAATYYCHQRSGYPYTFGGGTKVEIK

KS de-immunized VH5 (SEQ ID NO: 2031):
QIQLVQSGPELKKPGSSVKISCKASGYTFTNYGMNWVKQAPGKGLKWMGWINTYTGEPTYADDFKGRFA

FTLETSTSTAYLQLNNLRSEDTATYFCVRFISKGDYWGQGTTVTVSS

KS de-immunized VK5 (SEQ ID NO: 2032):
QILLTQSPASLAVSPGQRATITCSASSSVSYMLWYQQKPGSSPKPWIYDTSNLASGFPARFSGSGSGTS

YTLTINSLEAEDAATYYCHQRSGYPYTFGGGTKVEIK

KS VH mouse, peptide threaded (Mo PT) (SEQ ID NO: 2033):
QIQLVQSGPELKKPGETVKISCKASGYTFTNYGMNWVRQAPGKGLKWMGWINTYTGEPTYADDFKGRFV

FSLETSASTAFLQLNNLRSEDTATYFCVRFISKGDYWGQGTSVTVSS

KS VK mouse, peptide threaded (Mo PT) (SEQ ID NO: 2034):
QIVLTQSPATLSASPGERVTITCSASSSVSYMLWYLQKPGSSPKPWIFDTSNLASGFPSRFSGSGSGTT

YSLIISSLEAEDAATYYCHQRSGYPYTFGGGTKLEIK

KS VH mouse (SEQ ID NO: 2035):
QIQLVQSGPELKKPGETVKISCKASGYTFTNYGMNWVKQTPGKGLKWMGWINTYTGEPTYADDFKGRFA

FSLETSASTAFLQINNLRNEDMATYFCVRFISKGDYWGQGTSVTVSS

KS VK mouse (SEQ ID NO: 2036):
QILLTQSPAIMSASPGEKVTMTCSASSSVSYMLWYQQKPGSSPKPWIFDTSNLASGFPARFSGSGSGTS

YSLIISSMEAEDAATYYCHQRSGYPYTFGGGTKLEIK

SEQUENCE LISTING (2036 sequences)

SEQ ID NO: 1 - protein, 146 aa, Homo Sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 2 - protein, 13 aa, Artificial Sequence
  MHC class II binding epitope
VPIQKVQDDTKTL

SEQ ID NO: 3 - protein, 13 aa, Artificial Sequence
  MHC class II binding epitope
QKVQDDTKTLIKT

SEQ ID NO: 4 - protein, 13 aa, Artificial Sequence
  MHC class II binding epitope
KTLIKTIVTRIND

SEQ ID NO: 5 - protein, 13 aa, Artificial Sequence
  MHC class II binding epitope
TLIKTIVTRINDI

SEQ ID NO: 6 - protein, 13 aa, Artificial Sequence
  MHC class II binding epitope
KTIVTRINDISHT

SEQ ID NO: 7 - protein, 13 aa, Artificial Sequence
  MHC class II binding epitope
TIVTRINDISHTQ

SEQ ID NO: 8 - protein, 13 aa, Artificial Sequence
  MHC class II binding epitope
TRINDISHTQSVS

SEQ ID NO: 9 - protein, 13 aa, Artificial Sequence
  MHC class II binding epitope
NDISHTQSVSSKQ

SEQ ID NO: 10 - protein, 13 aa, Artificial Sequence
  MHC class II binding epitope
QSVSSKQKVTGLD

SEQ ID NO: 11 - protein, 13 aa, Artificial Sequence
  MHC class II binding epitope
SSKQKVTGLDFIP

SEQ ID NO: 12 - protein, 13 aa, Artificial Sequence
  MHC class II binding epitope
QKVTGLDFIPGLH

SEQ ID NO: 13 - protein, 13 aa, Artificial Sequence
  MHC class II binding epitope
TGLDFIPGLHPIL

SEQ ID NO: 14 - protein, 13 aa, Artificial Sequence
  MHC class II binding epitope
LDFIPGLHPILTL

SEQ ID NO: 15 - protein, 13 aa, Artificial Sequence
  MHC class II binding epitope
DFIPGLHPILTLS

SEQ ID NO: 16 - protein, 13 aa, Artificial Sequence
  MHC class II binding epitope
PGLHPILTLSKMD

SEQ ID NO: 17 - protein, 13 aa, Artificial Sequence
  MHC class II binding epitope
GLHPILTLSKMDQ

SEQ ID NO: 18 - protein, 13 aa, Artificial Sequence
  MHC class II binding epitope
HPILTLSKMDQTL

SEQ ID NO: 19 - protein, 13 aa, Artificial Sequence
  MHC class II binding epitope
PILTLSKMDQTLA

SEQ ID NO: 20 - protein, 13 aa, Artificial Sequence
  MHC class II binding epitope
LTLSKMDQTLAVY

SEQ ID NO: 21 - protein, 13 aa, Artificial Sequence
  MHC class II binding epitope
SKMDQTLAVYQQI

SEQ ID NO: 22 - protein, 13 aa, Artificial Sequence
  MHC class II binding epitope
QTLAVYQQILTSM

SEQ ID NO: 23 - protein, 13 aa, Artificial Sequence
  MHC class II binding epitope
LAVYQQILTSMPS

SEQ ID NO: 24 - protein, 13 aa, Artificial Sequence
  MHC class II binding epitope
AVYQQILTSMPSR

SEQ ID NO: 25 - protein, 13 aa, Artificial Sequence
  MHC class II binding epitope
QQILTSMPSRNVI

SEQ ID NO: 26 - protein, 13 aa, Artificial Sequence
  MHC class II binding epitope
QILTSMPSRNVIQ

SEQ ID NO: 27 - protein, 13 aa, Artificial Sequence
  MHC class II binding epitope
TSMPSRNVIQISN

SEQ ID NO: 28 - protein, 13 aa, Artificial Sequence
  MHC class II binding epitope
SRNVIQISNDLEN

SEQ ID NO: 29 - protein, 13 aa, Artificial Sequence
  MHC class II binding epitope
RNVIQISNDLENL

SEQ ID NO: 30 - protein, 13 aa, Artificial Sequence
  MHC class II binding epitope
NVIQISNDLENLR

SEQ ID NO: 31 - protein, 13 aa, Artificial Sequence
  MHC class II binding epitope
IQISNDLENLRDL

SEQ ID NO: 32 - protein, 13 aa, Artificial Sequence
  MHC class II binding epitope
NDLENLRDLLHVL

SEQ ID NO: 33 - protein, 13 aa, Artificial Sequence
  MHC class II binding epitope
LENLRDLLHVLAF

SEQ ID NO: 34 - protein, 13 aa, Artificial Sequence
  MHC class II binding epitope
ENLRDLLHVLAFS

SEQ ID NO: 35 - protein, 13 aa, Artificial Sequence
  MHC class II binding epitope
RDLLHVLAFSKSC

SEQ ID NO: 36 - protein, 13 aa, Artificial Sequence
  MHC class II binding epitope
DLLHVLAFSKSCH

SEQ ID NO: 37 - protein, 13 aa, Artificial Sequence
  MHC class II binding epitope
LHVLAFSKSCHLP

SEQ ID NO: 38 - protein, 13 aa, Artificial Sequence
  MHC class II binding epitope
HVLAFSKSCHLPW

SEQ ID NO: 39 - protein, 13 aa, Artificial Sequence
  MHC class II binding epitope
LAFSKSCHLPWAS

SEQ ID NO: 40 - protein, 13 aa, Artificial Sequence
  MHC class II binding epitope
CHLPWASGLETLD

SEQ ID NO: 41 - protein, 13 aa, Artificial Sequence
  MHC class II binding epitope
SGLETLDSLGGVL

SEQ ID NO: 42 - protein, 13 aa, Artificial Sequence
  MHC class II binding epitope
DSLGGVLEASGYS

SEQ ID NO: 43 - protein, 13 aa, Artificial Sequence
  MHC class II binding epitope
SLGGVLEASGYST

SEQ ID NO: 44 - protein, 13 aa, Artificial Sequence
  MHC class II binding epitope
GGVLEASGYSTEV

SEQ ID NO: 45 - protein, 13 aa, Artificial Sequence
  MHC class II binding epitope
SGYSTEVVSALRL

SEQ ID NO: 46 - protein, 152 aa, Homo Sapiens
RPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 47 - protein, 13 aa, Artificial Sequence
  MHC class II binding epitope
RKSSKMQAFRIWD

SEQ ID NO: 48 - protein, 13 aa, Artificial Sequence
  MHC class II binding epitope
SKMQAFRIWDVNQ

SEQ ID NO: 49 - protein, 13 aa, Artificial Sequence
  MHC class II binding epitope
QAFRIWDVNQKTF

SEQ ID NO: 50 - protein, 13 aa, Artificial Sequence
  MHC class II binding epitope
FRIWDVNQKTFYL

SEQ ID NO: 51 - protein, 13 aa, Artificial Sequence
  MHC class II binding epitope
RIWDVNQKTFYLR

SEQ ID NO: 52 - protein, 13 aa, Artificial Sequence
  MHC class II binding epitope
IWDVNQKTFYLRN

SEQ ID NO: 53 - protein, 13 aa, Artificial Sequence
  MHC class II binding epitope
WDVNQKTFYLRNN

SEQ ID NO: 54 - protein, 13 aa, Artificial Sequence
  MHC class II binding epitope
KTFYLRNNQLVAG

SEQ ID NO: 55 - protein, 13 aa, Artificial Sequence
  MHC class II binding epitope
TFYLRNNQLVAGY

SEQ ID NO: 56 - protein, 13 aa, Artificial Sequence
  MHC class II binding epitope
FYLRNNQLVAGYL

SEQ ID NO: 57 - protein, 13 aa, Artificial Sequence
  MHC class II binding epitope
LRNNQLVAGYLQG

SEQ ID NO: 58 - protein, 13 aa, Artificial Sequence
  MHC class II binding epitope
RNNQLVAGYLQGP

SEQ ID NO: 59 - protein, 13 aa, Artificial Sequence
  MHC class II binding epitope
NQLVAGYLQGPNV

SEQ ID NO: 60 - protein, 13 aa, Artificial Sequence
  MHC class II binding epitope
QLVAGYLQGPNVN

SEQ ID NO: 61 - protein, 13 aa, Artificial Sequence
  MHC class II binding epitope
LVAGYLQGPNVNL

SEQ ID NO: 62 - protein, 13 aa, Artificial Sequence
  MHC class II binding epitope
AGYLQGPNVNLEE

SEQ ID NO: 63 - protein, 13 aa, Artificial Sequence
  MHC class II binding epitope
GYLQGPNVNLEEK

SEQ ID NO: 64 - protein, 13 aa, Artificial Sequence
  MHC class II binding epitope
PNVNLEEKIDVVP

SEQ ID NO: 65 - protein, 13 aa, Artificial Sequence
  MHC class II binding epitope
VNLEEKIDVVPIE

SEQ ID NO: 66 - protein, 13 aa, Artificial Sequence
  MHC class II binding epitope
EKIDVVPIEPHAL

SEQ ID NO: 67 - protein, 13 aa, Artificial Sequence
  MHC class II binding epitope
IDVVPIEPHALFL

SEQ ID NO: 68 - protein, 13 aa, Artificial Sequence
  MHC class II binding epitope
DVVPIEPHALFLG

SEQ ID NO: 69 - protein, 13 aa, Artificial Sequence
  MHC class II binding epitope
VPIEPHALFLGIH

SEQ ID NO: 70 - protein, 13 aa, Artificial Sequence
  MHC class II binding epitope
HALFLGIHGGKMC

SEQ ID NO: 71 - protein, 13 aa, Artificial Sequence
  MHC class II binding epitope
ALFLGIHGGKMCL

SEQ ID NO: 72 - protein, 13 aa, Artificial Sequence
  MHC class II binding epitope
LFLGIHGGKMCLS

SEQ ID NO: 73 - protein, 13 aa, Artificial Sequence
  MHC class II binding epitope
LGIHGGKMCLSCV

SEQ ID NO: 74 - protein, 13 aa, Artificial Sequence
  MHC class II binding epitope
GKMCLSCVKSGDE

SEQ ID NO: 75 - protein, 13 aa, Artificial Sequence
  MHC class II binding epitope
MCLSCVKSGDETR

SEQ ID NO: 76 - protein, 13 aa, Artificial Sequence
  MHC class II binding epitope
SCVKSGDETRLQL

SEQ ID NO: 77 - protein, 13 aa, Artificial Sequence
  MHC class II binding epitope
ETRLQLEAVNITD

SEQ ID NO: 78 - protein, 13 aa, Artificial Sequence
  MHC class II binding epitope
TRLQLEAVNITDL

SEQ ID NO: 79 - protein, 13 aa, Artificial Sequence
  MHC class II binding epitope
LQLEAVNITDLSE

SEQ ID NO: 80 - protein, 13 aa, Artificial Sequence
  MHC class II binding epitope
EAVNITDLSENRK

SEQ ID NO: 81 - protein, 13 aa, Artificial Sequence
  MHC class II binding epitope
VNITDLSENRKQD

SEQ ID NO: 82 - protein, 13 aa, Artificial Sequence
  MHC class II binding epitope
TDLSENRKQDKRF

SEQ ID NO: 83 - protein, 13 aa, Artificial Sequence
  MHC class II binding epitope
ENRKQDKRFAFIR

SEQ ID NO: 84 - protein, 13 aa, Artificial Sequence
  MHC class II binding epitope
KRFAFIRSDSGPT

SEQ ID NO: 85 - protein, 13 aa, Artificial Sequence
  MHC class II binding epitope
FAFIRSDSGPTTS

SEQ ID NO: 86 - protein, 13 aa, Artificial Sequence
  MHC class II binding epitope
AFIRSDSGPTTSF

SEQ ID NO: 87 - protein, 13 aa, Artificial Sequence
  MHC class II binding epitope
TSFESAACPGWFL

SEQ ID NO: 88 - protein, 13 aa, Artificial Sequence
  MHC class II binding epitope
SFESAACPGWFLC

SEQ ID NO: 89 - protein, 13 aa, Artificial Sequence
  MHC class II binding epitope
PGWFLCTAMEADQ

SEQ ID NO: 90 - protein, 13 aa, Artificial Sequence
  MHC class II binding epitope
WFLCTAMEADQPV

SEQ ID NO: 91 - protein, 13 aa, Artificial Sequence
  MHC class II binding epitope
TAMEADQPVSLTN

SEQ ID NO: 92 - protein, 13 aa, Artificial Sequence
  MHC class II binding epitope
QPVSLTNMPDEGV

SEQ ID NO: 93 - protein, 13 aa, Artificial Sequence
  MHC class II binding epitope
VSLTNMPDEGVMV

SEQ ID NO: 94 - protein, 13 aa, Artificial Sequence
  MHC class II binding epitope
TNMPDEGVMVTKF

SEQ ID NO: 95 - protein, 13 aa, Artificial Sequence
  MHC class II binding epitope
PDEGVMVTKFYFQ

SEQ ID NO: 96 - protein, 13 aa, Artificial Sequence
  MHC class II binding epitope
EGVMVTKFYFQED

SEQ ID NO: 97 - protein, 13 aa, Artificial Sequence
  MHC class II binding epitope
GVMVTKFYFQEDE

SEQ ID NO: 98 - protein, 119 aa, Homo Sapiens
HSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 99 - protein, 13 aa, Artificial Sequence
  MHC class II binding epitope
GELSVCDSISEWV

SEQ ID NO: 100 - protein, 13 aa, Artificial Sequence
  MHC class II binding epitope
LSVCDSISEWVTA

SEQ ID NO: 101 - protein, 13 aa, Artificial Sequence
  MHC class II binding epitope
DSISEWVTAADKK

SEQ ID NO: 102 - protein, 13 aa, Artificial Sequence
  MHC class II binding epitope
SEWVTAADKKTAV

SEQ ID NO: 103 - protein, 13 aa, Artificial Sequence
  MHC class II binding epitope
EWVTAADKKTAVD

SEQ ID NO: 104 - protein, 13 aa, Artificial Sequence
  MHC class II binding epitope
WVTAADKKTAVDM

SEQ ID NO: 105 - protein, 13 aa, Artificial Sequence
  MHC class II binding epitope
KTAVDMSGGTVTV

SEQ ID NO: 106 - protein, 13 aa, Artificial Sequence
  MHC class II binding epitope
TAVDMSGGTVTVL

SEQ ID NO: 107 - protein, 13 aa, Artificial Sequence
  MHC class II binding epitope
VDMSGGTVTVLEK

SEQ ID NO: 108 - protein, 13 aa, Artificial Sequence
  MHC class II binding epitope
GTVTVLEKVPVSK

SEQ ID NO: 109 - protein, 13 aa, Artificial Sequence
  MHC class II binding epitope
VTVLEKVPVSKGQ

SEQ ID NO: 110 - protein, 13 aa, Artificial Sequence
  MHC class II binding epitope
TVLEKVPVSKGQL

SEQ ID NO: 111 - protein, 13 aa, Artificial Sequence
  MHC class II binding epitope
EKVPVSKGQLKQY

SEQ ID NO: 112 - protein, 13 aa, Artificial Sequence
  MHC class II binding epitope
VPVSKGQLKQYFY

SEQ ID NO: 113 - protein, 13 aa, Artificial Sequence
  MHC class II binding epitope
GQLKQYFYETKCN

SEQ ID NO: 114 - protein, 13 aa, Artificial Sequence
  MHC class II binding epitope
KQYFYETKCNPMG

SEQ ID NO: 115 - protein, 13 aa, Artificial Sequence
  MHC class II binding epitope
QYFYETKCNPMGY

SEQ ID NO: 116 - protein, 13 aa, Artificial Sequence
  MHC class II binding epitope
YFYETKCNPMGYT

SEQ ID NO: 117 - protein, 13 aa, Artificial Sequence
  MHC class II binding epitope
NPMGYTKEGCRGI

SEQ ID NO: 118 - protein, 13 aa, Artificial Sequence
  MHC class II binding epitope
MGYTKEGCRGIDK

SEQ ID NO: 119 - protein, 13 aa, Artificial Sequence
  MHC class II binding epitope
RGIDKRHWNSQCR

SEQ ID NO: 120 - protein, 13 aa, Artificial Sequence
  MHC class II binding epitope
RHWNSQCRTTQSY

SEQ ID NO: 121 - protein, 13 aa, Artificial Sequence
  MHC class II binding epitope
HWNSQCRTTQSYV

SEQ ID NO: 122 - protein, 13 aa, Artificial Sequence
  MHC class II binding epitope
QSYVRALTMDSKK

SEQ ID NO: 123 - protein, 13 aa, Artificial Sequence
  MHC class II binding epitope
SYVRALTMDSKKR

SEQ ID NO: 124 - protein, 13 aa, Artificial Sequence
  MHC class II binding epitope
RALTMDSKKRIGW

SEQ ID NO: 125 - protein, 13 aa, Artificial Sequence
  MHC class II binding epitope
LTMDSKKRIGWRF

SEQ ID NO: 126 - protein, 13 aa, Artificial Sequence
  MHC class II binding epitope
KRIGWRFIRIDTS

SEQ ID NO: 127 - protein, 13 aa, Artificial Sequence
  MHC class II binding epitope
IGWRFIRIDTSCV

SEQ ID NO: 128 - protein, 13 aa, Artificial Sequence
  MHC class II binding epitope
GWRFIRIDTSCVC

SEQ ID NO: 129 - protein, 13 aa, Artificial Sequence
  MHC class II binding epitope
WRFIRIDTSCVCT

SEQ ID NO: 130 - protein, 13 aa, Artificial Sequence
  MHC class II binding epitope
RFIRIDTSCVCTL

SEQ ID NO: 131 - protein, 13 aa, Artificial Sequence
  MHC class II binding epitope
IRIDTSCVCTLTI

SEQ ID NO: 132 - protein, 13 aa, Artificial Sequence
  MHC class II binding epitope
IDTSCVCTLTIKR

SEQ ID NO: 133 - protein, 166 aa, Homo Sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 134 - protein, 13 aa, Artificial Sequence
  MHC class II binding epitope
PRLICDSRVLERY

SEQ ID NO: 135 - protein, 13 aa, Artificial Sequence
  MHC class II binding epitope
RLICDSRVLERYL

SEQ ID NO: 136 - protein, 13 aa, Artificial Sequence
  MHC class II binding epitope
ICDSRVLERYLLE

SEQ ID NO: 137 - protein, 13 aa, Artificial Sequence
  MHC class II binding epitope
CDSRVLERYLLEA

SEQ ID NO: 138 - protein, 13 aa, Artificial Sequence
  MHC class II binding epitope
SRVLERYLLEAKE

SEQ ID NO: 139 - protein, 13 aa, Artificial Sequence
  MHC class II binding epitope
RVLERYLLEAKEA

SEQ ID NO: 140 - protein, 13 aa, Artificial Sequence
  MHC class II binding epitope
LERYLLEAKEAEN

SEQ ID NO: 141 - protein, 13 aa, Artificial Sequence
  MHC class II binding epitope
ERYLLEAKEAENI

SEQ ID NO: 142 - protein, 13 aa, Artificial Sequence
  MHC class II binding epitope
RYLLEAKEAENIT

SEQ ID NO: 143 - protein, 13 aa, Artificial Sequence
  MHC class II binding epitope
YLLEAKEAENITT

SEQ ID NO: 144 - protein, 13 aa, Artificial Sequence
  MHC class II binding epitope
LEAKEAENITTGC

SEQ ID NO: 145 - protein, 13 aa, Artificial Sequence
  MHC class II binding epitope
KEAENITTGCAEH

SEQ ID NO: 146 - protein, 13 aa, Artificial Sequence
  MHC class II binding epitope
ENITTGCAEHCSL

SEQ ID NO: 147 - protein, 13 aa, Artificial Sequence
  MHC class II binding epitope
CSLNENITVPDTK

SEQ ID NO: 148 - protein, 13 aa, Artificial Sequence
  MHC class II binding epitope
NENITVPDTKVNF

SEQ ID NO: 149 - protein, 13 aa, Artificial Sequence
  MHC class II binding epitope
ENITVPDTKVNFY

SEQ ID NO: 150 - protein, 13 aa, Artificial Sequence
  MHC class II binding epitope
NITVPDTKVNFYA

SEQ ID NO: 151 - protein, 13 aa, Artificial Sequence
  MHC class II binding epitope
ITVPDTKVNFYAW

SEQ ID NO: 152 - protein, 13 aa, Artificial Sequence
  MHC class II binding epitope
TKVNFYAWKRMEV

SEQ ID NO: 153 - protein, 13 aa, Artificial Sequence
  MHC class II binding epitope
VNFYAWKRMEVGQ

SEQ ID NO: 154 - protein, 13 aa, Artificial Sequence
  MHC class II binding epitope
NFYAWKRMEVGQQ

SEQ ID NO: 155 - protein, 13 aa, Artificial Sequence
  MHC class II binding epitope
YAWKRMEVGQQAV

SEQ ID NO: 156 - protein, 13 aa, Artificial Sequence
  MHC class II binding epitope
KRMEVGQQAVEVW

SEQ ID NO: 157 - protein, 13 aa, Artificial Sequence
  MHC class II binding epitope
RMEVGQQAVEVWQ

SEQ ID NO: 158 - protein, 13 aa, Artificial Sequence
  MHC class II binding epitope
MEVGQQAVEVWQG

SEQ ID NO: 159 - protein, 13 aa, Artificial Sequence
  MHC class II binding epitope
QAVEVWQGLALLS

SEQ ID NO: 160 - protein, 13 aa, Artificial Sequence
  MHC class II binding epitope
AVEVWQGLALLSE

SEQ ID NO: 161 - protein, 13 aa, Artificial Sequence
  MHC class II binding epitope
VEVWQGLALLSEA

SEQ ID NO: 162 - protein, 13 aa, Artificial Sequence
  MHC class II binding epitope
EVWQGLALLSEAV

SEQ ID NO: 163 - protein, 13 aa, Artificial Sequence
  MHC class II binding epitope
VWQGLALLSEAVL

SEQ ID NO: 164 - protein, 13 aa, Artificial Sequence
  MHC class II binding epitope
WQGLALLSEAVLR

SEQ ID NO: 165 - protein, 13 aa, Artificial Sequence
  MHC class II binding epitope
QGLALLSEAVLRG

SEQ ID NO: 166 - protein, 13 aa, Artificial Sequence
  MHC class II binding epitope
LALLSEAVLRGQA

SEQ ID NO: 167 - protein, 13 aa, Artificial Sequence
  MHC class II binding epitope
ALLSEAVLRGQAL

SEQ ID NO: 168 - protein, 13 aa, Artificial Sequence
  MHC class II binding epitope
LSEAVLRGQALLV

SEQ ID NO: 169 - protein, 13 aa, Artificial Sequence
  MHC class II binding epitope
SEAVLRGQALLVN

SEQ ID NO: 170 - protein, 13 aa, Artificial Sequence
  MHC class II binding epitope
EAVLRGQALLVNS

SEQ ID NO: 171 - protein, 13 aa, Artificial Sequence
  MHC class II binding epitope
AVLRGQALLVNSS

SEQ ID NO: 172 - protein, 13 aa, Artificial Sequence
  MHC class II binding epitope
QALLVNSSQPWEP

SEQ ID NO: 173 - protein, 13 aa, Artificial Sequence
  MHC class II binding epitope
ALLVNSSQPWEPL

SEQ ID NO: 174 - protein, 13 aa, Artificial Sequence
  MHC class II binding epitope
LLVNSSQPWEPLQ

SEQ ID NO: 175 - protein, 13 aa, Artificial Sequence
  MHC class II binding epitope
QPWEPLQLHVDKA

SEQ ID NO: 176 - protein, 13 aa, Artificial Sequence
  MHC class II binding epitope
EPLQLHVDKAVSG

SEQ ID NO: 177 - protein, 13 aa, Artificial Sequence
  MHC class II binding epitope
LQLHVDKAVSGLR

SEQ ID NO: 178 - protein, 13 aa, Artificial Sequence
  MHC class II binding epitope
LHVDKAVSGLRSL

SEQ ID NO: 179 - protein, 13 aa, Artificial Sequence
  MHC class II binding epitope
KAVSGLRSLTTLL

SEQ ID NO: 180 - protein, 13 aa, Artificial Sequence
  MHC class II binding epitope
SGLRSLTTLLRAL

SEQ ID NO: 181 - protein, 13 aa, Artificial Sequence
  MHC class II binding epitope
RSLTTLLRALGAQ

SEQ ID NO: 182 - protein, 13 aa, Artificial Sequence
  MHC class II binding epitope
SLTTLLRALGAQK

SEQ ID NO: 183 - protein, 13 aa, Artificial Sequence
  MHC class II binding epitope
TTLLRALGAQKEA

SEQ ID NO: 184 - protein, 13 aa, Artificial Sequence
  MHC class II binding epitope
TLLRALGAQKEAI

SEQ ID NO: 185 - protein, 13 aa, Artificial Sequence
  MHC class II binding epitope
RALGAQKEAISPP

SEQ ID NO: 186 - protein, 13 aa, Artificial Sequence
  MHC class II binding epitope
AQKEAISPPDAAS

SEQ ID NO: 187 - protein, 13 aa, Artificial Sequence
  MHC class II binding epitope
EAISPPDAASAAP

SEQ ID NO: 188 - protein, 13 aa, Artificial Sequence
  MHC class II binding epitope
SPPDAASAAPLRT

SEQ ID NO: 189 - protein, 13 aa, Artificial Sequence
  MHC class II binding epitope
ASAAPLRTITADT

SEQ ID NO: 190 - protein, 13 aa, Artificial Sequence
  MHC class II binding epitope
APLRTITADTFRK

SEQ ID NO: 191 - protein, 13 aa, Artificial Sequence
  MHC class II binding epitope
RTITADTFRKLFR

SEQ ID NO: 192 - protein, 13 aa, Artificial Sequence
  MHC class II binding epitope
TITADTFRKLFRV

SEQ ID NO: 193 - protein, 13 aa, Artificial Sequence
  MHC class II binding epitope
DTFRKLFRVYSNF

SEQ ID NO: 194 - protein, 13 aa, Artificial Sequence
  MHC class II binding epitope
RKLFRVYSNFLRG

SEQ ID NO: 195 - protein, 13 aa, Artificial Sequence
  MHC class II binding epitope
KLFRVYSNFLRGK

SEQ ID NO: 196 - protein, 13 aa, Artificial Sequence
  MHC class II binding epitope
FRVYSNFLRGKLK

SEQ ID NO: 197 - protein, 13 aa, Artificial Sequence
  MHC class II binding epitope
RVYSNFLRGKLKL

SEQ ID NO: 198 - protein, 13 aa, Artificial Sequence
  MHC class II binding epitope
YSNFLRGKLKLYT

SEQ ID NO: 199 - protein, 13 aa, Artificial Sequence
  MHC class II binding epitope
SNFLRGKLKLYTG

SEQ ID NO: 200 - protein, 13 aa, Artificial Sequence
  MHC class II binding epitope
NFLRGKLKLYTGE

SEQ ID NO: 201 - protein, 13 aa, Artificial Sequence
  MHC class II binding epitope
RGKLKLYTGEACR

SEQ ID NO: 202 - protein, 13 aa, Artificial Sequence
  MHC class II binding epitope
GKLKLYTGEACRT

SEQ ID NO: 203 - protein, 13 aa, Artificial Sequence
  MHC class II binding epitope
LKLYTGEACRTGD

SEQ ID NO: 204 - protein, 13 aa, Artificial Sequence
  MHC class II binding epitope
KLYTGEACRTGDR

SEQ ID NO: 205 - protein, 174 aa, Homo Sapiens
TPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 206 - protein, 13 aa, Artificial Sequence
  MHC class II binding epitope
TPLGPASSLPQSF

SEQ ID NO: 207 - protein, 13 aa, Artificial Sequence
  MHC class II binding epitope
SSLPQSFLLKCLE

SEQ ID NO: 208 - protein, 13 aa, Artificial Sequence
  MHC class II binding epitope
QSFLLKCLEQVRK

SEQ ID NO: 209 - protein, 13 aa, Artificial Sequence
  MHC class II binding epitope
SFLLKCLEQVRKI

SEQ ID NO: 210 - protein, 13 aa, Artificial Sequence
  MHC class II binding epitope
FLLKCLEQVRKIQ

SEQ ID NO: 211 - protein, 13 aa, Artificial Sequence
  MHC class II binding epitope
KCLEQVRKIQGDG

SEQ ID NO: 212 - protein, 13 aa, Artificial Sequence
  MHC class II binding epitope
EQVRKIQGDGAAL

SEQ ID NO: 213 - protein, 13 aa, Artificial Sequence
  MHC class II binding epitope
RKIQGDGAALQEK

SEQ ID NO: 214 - protein, 13 aa, Artificial Sequence
  MHC class II binding epitope
AALQEKLVSECAT

SEQ ID NO: 215 - protein, 13 aa, Artificial Sequence
  MHC class II binding epitope
EKLVSECATYKLC

SEQ ID NO: 216 - protein, 13 aa, Artificial Sequence
  MHC class II binding epitope
KLVSECATYKLCH

SEQ ID NO: 217 - protein, 13 aa, Artificial Sequence
  MHC class II binding epitope
AALQEKLCATYKL

SEQ ID NO: 218 - protein, 13 aa, Artificial Sequence
  MHC class II binding epitope
EKLCATYKLCHPE

SEQ ID NO: 219 - protein, 13 aa, Artificial Sequence
  MHC class II binding epitope
ATYKLCHPEELVL

SEQ ID NO: 220 - protein, 13 aa, Artificial Sequence
  MHC class II binding epitope
YKLCHPEELVLLG

SEQ ID NO: 221 - protein, 13 aa, Artificial Sequence
  MHC class II binding epitope
EELVLLGHSLGIP

SEQ ID NO: 222 - protein, 13 aa, Artificial Sequence
  MHC class II binding epitope
ELVLLGHSLGIPW

SEQ ID NO: 223 - protein, 13 aa, Artificial Sequence
  MHC class II binding epitope
HSLGIPWAPLSSC

SEQ ID NO: 224 - protein, 13 aa, Artificial Sequence
  MHC class II binding epitope
IPWAPLSSCPSQA

SEQ ID NO: 225 - protein, 13 aa, Artificial Sequence
  MHC class II binding epitope
APLSSCPSQALQL

SEQ ID NO: 226 - protein, 13 aa, Artificial Sequence
  MHC class II binding epitope
QALQLAGCLSQLH

SEQ ID NO: 227 - protein, 13 aa, Artificial Sequence
  MHC class II binding epitope
GCLSQLHSGLFLY

SEQ ID NO: 228 - protein, 13 aa, Artificial Sequence
  MHC class II binding epitope
SQLHSGLFLYQGL

SEQ ID NO: 229 - protein, 13 aa, Artificial Sequence
  MHC class II binding epitope
SGLFLYQGLLQAL

SEQ ID NO: 230 - protein, 13 aa, Artificial Sequence
  MHC class II binding epitope
GLFLYQGLLQALE

SEQ ID NO: 231 - protein, 13 aa, Artificial Sequence
  MHC class II binding epitope
LFLYQGLLQALEG

SEQ ID NO: 232 - protein, 13 aa, Artificial Sequence
  MHC class II binding epitope
FLYQGLLQALEGI

SEQ ID NO: 233 - protein, 13 aa, Artificial Sequence
  MHC class II binding epitope
QGLLQALEGISPE

SEQ ID NO: 234 - protein, 13 aa, Artificial Sequence
  MHC class II binding epitope
GLLQALEGISPEL

SEQ ID NO: 235 - protein, 13 aa, Artificial Sequence
  MHC class II binding epitope
QALEGISPELGPT

SEQ ID NO: 236 - protein, 13 aa, Artificial Sequence
  MHC class II binding epitope
EGISPELGPTLDT

SEQ ID NO: 237 - protein, 13 aa, Artificial Sequence
  MHC class II binding epitope
PTLDTLQLDVADF

SEQ ID NO: 238 - protein, 13 aa, Artificial Sequence
  MHC class II binding epitope
DTLQLDVADFATT

SEQ ID NO: 239 - protein, 13 aa, Artificial Sequence
  MHC class II binding epitope
LQLDVADFATTIW

SEQ ID NO: 240 - protein, 13 aa, Artificial Sequence
  MHC class II binding epitope
LDVADFATTIWQQ

SEQ ID NO: 241 - protein, 13 aa, Artificial Sequence
  MHC class II binding epitope
TTIWQQMEELGMA

SEQ ID NO: 242 - protein, 13 aa, Artificial Sequence
  MHC class II binding epitope
TIWQQMEELGMAP

SEQ ID NO: 243 - protein, 13 aa, Artificial Sequence
  MHC class II binding epitope
QQMEELGMAPALQ

SEQ ID NO: 244 - protein, 13 aa, Artificial Sequence
  MHC class II binding epitope
EELGMAPALQPTQ

SEQ ID NO: 245 - protein, 13 aa, Artificial Sequence
  MHC class II binding epitope
LGMAPALQPTQGA

SEQ ID NO: 246 - protein, 13 aa, Artificial Sequence
  MHC class II binding epitope
PALQPTQGAMPAF

SEQ ID NO: 247 - protein, 13 aa, Artificial Sequence
  MHC class II binding epitope
GAMPAFASAFQRR

SEQ ID NO: 248 - protein, 13 aa, Artificial Sequence
  MHC class II binding epitope
PAFASAFQRRAGG

SEQ ID NO: 249 - protein, 13 aa, Artificial Sequence
  MHC class II binding epitope
SAFQRRAGGVLVA

SEQ ID NO: 250 - protein, 13 aa, Artificial Sequence
  MHC class II binding epitope
GGVLVASHLQSFL

SEQ ID NO: 251 - protein, 13 aa, Artificial Sequence
  MHC class II binding epitope
GVLVASHLQSFLE

SEQ ID NO: 252 - protein, 13 aa, Artificial Sequence
  MHC class II binding epitope
VLVASHLQSFLEV

SEQ ID NO: 253 - protein, 13 aa, Artificial Sequence
  MHC class II binding epitope
SHLQSFLEVSYRV

SEQ ID NO: 254 - protein, 13 aa, Artificial Sequence
  MHC class II binding epitope
QSFLEVSYRVLRH

SEQ ID NO: 255 - protein, 13 aa, Artificial Sequence
  MHC class II binding epitope
SFLEVSYRVLRHL

SEQ ID NO: 256 - protein, 13 aa, Artificial Sequence
  MHC class II binding epitope
LEVSYRVLRHLAQ

SEQ ID NO: 257 - protein, 164 aa, Homo Sapiens
MCNDMTPEQMATNVNCSSPERHTRSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 258 - protein, 13 aa, Artificial Sequence
  MHC class II binding epitope
NDMTPEQMATNVN

SEQ ID NO: 259 - protein, 13 aa, Artificial Sequence
  MHC class II binding epitope
DMTPEQMATNVNC

SEQ ID NO: 260 - protein, 13 aa, Artificial Sequence
  MHC class II binding epitope
EQMATNVNCSSPE

SEQ ID NO: 261 - protein, 13 aa, Artificial Sequence
  MHC class II binding epitope
TNVNCSSPERHTR

SEQ ID NO: 262 - protein, 13 aa, Artificial Sequence
  MHC class II binding epitope
RSYDYMEGGDIRV

SEQ ID NO: 263 - protein, 13 aa, Artificial Sequence
  MHC class II binding epitope
YDYMEGGDIRVRR

SEQ ID NO: 264 - protein, 13 aa, Artificial Sequence
  MHC class II binding epitope
DYMEGGDIRVRRL

SEQ ID NO: 265 - protein, 13 aa, Artificial Sequence
  MHC class II binding epitope
GDIRVRRLFCRTQ

SEQ ID NO: 266 - protein, 13 aa, Artificial Sequence
  MHC class II binding epitope
IRVRRLFCRTQWY

SEQ ID NO: 267 - protein, 13 aa, Artificial Sequence
  MHC class II binding epitope
RRLFCRTQWYLRI

SEQ ID NO: 268 - protein, 13 aa, Artificial Sequence
  MHC class II binding epitope
RLFCRTQWYLRID

SEQ ID NO: 269 - protein, 13 aa, Artificial Sequence
  MHC class II binding epitope
TQWYLRIDKRGKV

SEQ ID NO: 270 - protein, 13 aa, Artificial Sequence
  MHC class II binding epitope
QWYLRIDKRGKVK

SEQ ID NO: 271 - protein, 13 aa, Artificial Sequence
  MHC class II binding epitope
WYLRIDKRGKVKG

SEQ ID NO: 272 - protein, 13 aa, Artificial Sequence
  MHC class II binding epitope
LRIDKRGKVKGTQ

SEQ ID NO: 273 - protein, 13 aa, Artificial Sequence
  MHC class II binding epitope
GKVKGTQEMKNNY

SEQ ID NO: 274 - protein, 13 aa, Artificial Sequence
  MHC class II binding epitope
QEMKNNYNIMEIR

SEQ ID NO: 275 - protein, 13 aa, Artificial Sequence
  MHC class II binding epitope
NNYNIMEIRTVAV

SEQ ID NO: 276 - protein, 13 aa, Artificial Sequence
  MHC class II binding epitope
YNIMEIRTVAVGI

SEQ ID NO: 277 - protein, 13 aa, Artificial Sequence
  MHC class II binding epitope
NIMEIRTVAVGIV

SEQ ID NO: 278 - protein, 13 aa, Artificial Sequence
  MHC class II binding epitope
MEIRTVAVGIVAI

SEQ ID NO: 279 - protein, 13 aa, Artificial Sequence
  MHC class II binding epitope
RTVAVGIVAIKGV

SEQ ID NO: 280 - protein, 13 aa, Artificial Sequence
  MHC class II binding epitope
VAVGIVAIKGVES

SEQ ID NO: 281 - protein, 13 aa, Artificial Sequence
  MHC class II binding epitope
VGIVAIKGVESEF

SEQ ID NO: 282 - protein, 13 aa, Artificial Sequence
  MHC class II binding epitope
VAIKGVESEFYLA

SEQ ID NO: 283 - protein, 13 aa, Artificial Sequence
  MHC class II binding epitope
KGVESEFYLAMNK

SEQ ID NO: 284 - protein, 13 aa, Artificial Sequence
  MHC class II binding epitope
SEFYLAMNKEGKL

SEQ ID NO: 285 - protein, 13 aa, Artificial Sequence
  MHC class II binding epitope
EFYLAMNKEGKLY

SEQ ID NO: 286 - protein, 13 aa, Artificial Sequence
  MHC class II binding epitope
FYLAMNKEGKLYA

SEQ ID NO: 287 - protein, 13 aa, Artificial Sequence
  MHC class II binding epitope
LAMNKEGKLYAKK

SEQ ID NO: 288 - protein, 13 aa, Artificial Sequence
  MHC class II binding epitope
GKLYAKKECNEDC

SEQ ID NO: 289 - protein, 13 aa, Artificial Sequence
  MHC class II binding epitope
KLYAKKECNEDCN

SEQ ID NO: 290 - protein, 13 aa, Artificial Sequence
  MHC class II binding epitope
CNFKELILENHYN

SEQ ID NO: 291 - protein, 13 aa, Artificial Sequence
  MHC class II binding epitope
KELILENHYNTYA

SEQ ID NO: 292 - protein, 13 aa, Artificial Sequence
  MHC class II binding epitope
ELILENHYNTYAS

SEQ ID NO: 293 - protein, 13 aa, Artificial Sequence
  MHC class II binding epitope
LILENHYNTYASA

SEQ ID NO: 294 - protein, 13 aa, Artificial Sequence
  MHC class II binding epitope
NHYNTYASAKWTH

SEQ ID NO: 295 - protein, 13 aa, Artificial Sequence
  MHC class II binding epitope
NTYASAKWTHNGG

SEQ ID NO: 296 - protein, 13 aa, Artificial Sequence
  MHC class II binding epitope
AKWTHNGGEMFVA

SEQ ID NO: 297 - protein, 13 aa, Artificial Sequence
  MHC class II binding epitope
GEMFVALNQKGIP

SEQ ID NO: 298 - protein, 13 aa, Artificial Sequence
  MHC class II binding epitope
EMFVALNQKGIPV

SEQ ID NO: 299 - protein, 13 aa, Artificial Sequence
  MHC class II binding epitope
FVALNQKGIPVRG

SEQ ID NO: 300 - protein, 13 aa, Artificial Sequence
  MHC class II binding epitope
VALNQKGIPVRGK

SEQ ID NO: 301 - protein, 13 aa, Artificial Sequence
  MHC class II binding epitope
KGIPVRGKKTKKE

SEQ ID NO: 302 - protein, 13 aa, Artificial Sequence
  MHC class II binding epitope
IPVRGKKTKKEQK

SEQ ID NO: 303 - protein, 13 aa, Artificial Sequence
  MHC class II binding epitope
KTKKEQKTAHFLP

SEQ ID NO: 304 - protein, 13 aa, Artificial Sequence
  MHC class II binding epitope
DSVCPQGKYIHPQ

SEQ ID NO: 305 - protein, 13 aa, Artificial Sequence
  MHC class II binding epitope
KYIHPQNNSICCT

SEQ ID NO: 306 - protein, 13 aa, Artificial Sequence
  MHC class II binding epitope
NSICCTKCHKGTY

SEQ ID NO: 307 - protein, 13 aa, Artificial Sequence
  MHC class II binding epitope
TYLYNDCPGPGQD

SEQ ID NO: 308 - protein, 13 aa, Artificial Sequence
  MHC class II binding epitope
YLYNDCPGPGQDT

SEQ ID NO: 309 - protein, 13 aa, Artificial Sequence
  MHC class II binding epitope
NHLRHCLSCSKCR

SEQ ID NO: 310 - protein, 13 aa, Artificial Sequence
  MHC class II binding epitope
HCLSCSKCRKEMG

SEQ ID NO: 311 - protein, 13 aa, Artificial Sequence
  MHC class II binding epitope
KEMGQVEISSCTV

SEQ ID NO: 312 - protein, 13 aa, Artificial Sequence
  MHC class II binding epitope
GQVEISSCTVDRD

SEQ ID NO: 313 - protein, 13 aa, Artificial Sequence
  MHC class II binding epitope
VEISSCTVDRDTV

SEQ ID NO: 314 - protein, 13 aa, Artificial Sequence
  MHC class II binding epitope
CTVDRDTVCGCRK

SEQ ID NO: 315 - protein, 13 aa, Artificial Sequence
  MHC class II binding epitope
DTVCGCRKNQYRH

SEQ ID NO: 316 - protein, 13 aa, Artificial Sequence
  MHC class II binding epitope
NQYRHYWSENLFQ

SEQ ID NO: 317 - protein, 13 aa, Artificial Sequence
  MHC class II binding epitope
RHYWSENLFQCFN

SEQ ID NO: 318 - protein, 13 aa, Artificial Sequence
  MHC class II binding epitope
HYWSENLFQCFNC

SEQ ID NO: 319 - protein, 13 aa, Artificial Sequence
  MHC class II binding epitope
ENLFQCFNCSLCL

SEQ ID NO: 320 - protein, 13 aa, Artificial Sequence
  MHC class II binding epitope
NLFQCFNCSLCLN

SEQ ID NO: 321 - protein, 13 aa, Artificial Sequence
  MHC class II binding epitope
QCFNCSLCLNGTV

SEQ ID NO: 322 - protein, 13 aa, Artificial Sequence
  MHC class II binding epitope
CSLCLNGTVHLSC

SEQ ID NO: 323 - protein, 13 aa, Artificial Sequence
  MHC class II binding epitope
LCLNGTVHLSCQE

SEQ ID NO: 324 - protein, 13 aa, Artificial Sequence
  MHC class II binding epitope
GTVHLSCQEKQNT

SEQ ID NO: 325 - protein, 13 aa, Artificial Sequence
  MHC class II binding epitope
VHLSCQEKQNTVC

SEQ ID NO: 326 - protein, 13 aa, Artificial Sequence
  MHC class II binding epitope
EKQNTVCTCHAGF

SEQ ID NO: 327 - protein, 13 aa, Artificial Sequence
  MHC class II binding epitope
NTVCTCHAGFFLR

SEQ ID NO: 328 - protein, 13 aa, Artificial Sequence
  MHC class II binding epitope
GFFLRENECVSCS

SEQ ID NO: 329 - protein, 13 aa, Artificial Sequence
  MHC class II binding epitope
FFLRENECVSCSN

SEQ ID NO: 330 - protein, 13 aa, Artificial Sequence
  MHC class II binding epitope
ECVSCSNCKKSLE

SEQ ID NO: 331 - protein, 13 aa, Artificial Sequence
  MHC class II binding epitope
KSLECTKLCLPQI

SEQ ID NO: 332 - protein, 13 aa, Artificial Sequence
  MHC class II binding epitope
TKLCLPQIENVKG

SEQ ID NO: 333 - protein, 13 aa, Artificial Sequence
  MHC class II binding epitope
LCLPQIENVKGTE

SEQ ID NO: 334 - protein, 13 aa, Artificial Sequence
  MHC class II binding epitope
PQIENVKGTEDSG

SEQ ID NO: 335 - protein, 13 aa, Artificial Sequence
  MHC class II binding epitope
SGTTVLLPLVIFF

SEQ ID NO: 336 - protein, 13 aa, Artificial Sequence
  MHC class II binding epitope
TPYAPEPGSTCRL

SEQ ID NO: 337 - protein, 13 aa, Artificial Sequence
  MHC class II binding epitope
CRLREYYDQTAQM

SEQ ID NO: 338 - protein, 13 aa, Artificial Sequence
  MHC class II binding epitope
REYYDQTAQMCCS

SEQ ID NO: 339 - protein, 13 aa, Artificial Sequence
  MHC class II binding epitope
EYYDQTAQMCCSK

SEQ ID NO: 340 - protein, 13 aa, Artificial Sequence
  MHC class II binding epitope
AQMCCSKCSPGQH

SEQ ID NO: 341 - protein, 13 aa, Artificial Sequence
  MHC class II binding epitope
KCSPGQHAKVFCT

SEQ ID NO: 342 - protein, 13 aa, Artificial Sequence
  MHC class II binding epitope
AKVFCTKTSDTVC

SEQ ID NO: 343 - protein, 13 aa, Artificial Sequence
  MHC class II binding epitope
KVFCTKTSDTVCD

SEQ ID NO: 344 - protein, 13 aa, Artificial Sequence
  MHC class II binding epitope
STYTQLWNWVPEC

SEQ ID NO: 345 - protein, 13 aa, Artificial Sequence
  MHC class II binding epitope
TQLWNWVPECLSC

SEQ ID NO: 346 - protein, 13 aa, Artificial Sequence
  MHC class II binding epitope
QLWNWVPECLSCG

SEQ ID NO: 347 - protein, 13 aa, Artificial Sequence
  MHC class II binding epitope
NWVPECLSCGSRC

SEQ ID NO: 348 - protein, 13 aa, Artificial Sequence
  MHC class II binding epitope
ECLSCGSRCSSDQ

SEQ ID NO: 349 - protein, 13 aa, Artificial Sequence
  MHC class II binding epitope
SRCSSDQEVTQAC

SEQ ID NO: 350 - protein, 13 aa, Artificial Sequence
  MHC class II binding epitope
QEVTQACTREQNR

SEQ ID NO: 351 - protein, 13 aa, Artificial Sequence
  MHC class II binding epitope
QNRICTCRPGWYC

SEQ ID NO: 352 - protein, 13 aa, Artificial Sequence
  MHC class II binding epitope
NRICTCRPGWYCA

SEQ ID NO: 353 - protein, 13 aa, Artificial Sequence
  MHC class II binding epitope
PGWYCALSKQEGC

SEQ ID NO: 354 - protein, 13 aa, Artificial Sequence
  MHC class II binding epitope
GWYCALSKQEGCR

SEQ ID NO: 355 - protein, 13 aa, Artificial Sequence
  MHC class II binding epitope
CALSKQEGCRLCA

SEQ ID NO: 356 - protein, 13 aa, Artificial Sequence
  MHC class II binding epitope
APLRKCRPGFGVA

SEQ ID NO: 357 - protein, 13 aa, Artificial Sequence
  MHC class II binding epitope
PGFGVARPGTETS

SEQ ID NO: 358 - protein, 13 aa, Artificial Sequence
  MHC class II binding epitope
FGVARPGTETSDV

SEQ ID NO: 359 - protein, 13 aa, Artificial Sequence
  MHC class II binding epitope
SDVVCKPCAPGTF

SEQ ID NO: 360 - protein, 13 aa, Artificial Sequence
  MHC class II binding epitope
GTFSNTTSSTDIC

SEQ ID NO: 361 - protein, 13 aa, Artificial Sequence
  MHC class II binding epitope
TDICRPHQICNVV

SEQ ID NO: 362 - protein, 13 aa, Artificial Sequence
  MHC class II binding epitope
HQICNVVAIPGNA

SEQ ID NO: 363 - protein, 13 aa, Artificial Sequence
  MHC class II binding epitope
ICNVVAIPGNASR

SEQ ID NO: 364 - protein, 13 aa, Artificial Sequence
  MHC class II binding epitope
CNVVAIPGNASRD

SEQ ID NO: 365 - protein, 13 aa, Artificial Sequence
  MHC class II binding epitope
NVVAIPGNASRDA

SEQ ID NO: 366 - protein, 13 aa, Artificial Sequence
  MHC class II binding epitope
VAIPGNASRDAVC

SEQ ID NO: 367 - protein, 13 aa, Artificial Sequence
  MHC class II binding epitope
DAVCTSTTTPTRS

SEQ ID NO: 368 - protein, 13 aa, Artificial Sequence
  MHC class II binding epitope
TRSMAPGAVHLPQ

SEQ ID NO: 369 - protein, 13 aa, Artificial Sequence
  MHC class II binding epitope
RSMAPGAVHLPQP

SEQ ID NO: 370 - protein, 13 aa, Artificial Sequence
  MHC class II binding epitope
VHLPQPVSTRSQH

SEQ ID NO: 371 - protein, 13 aa, Artificial Sequence
  MHC class II binding epitope
QPVSTRSQHTQPT

SEQ ID NO: 372 - protein, 13 aa, Artificial Sequence
  MHC class II binding epitope
PEPSTAPSTSFLL

SEQ ID NO: 373 - protein, 13 aa, Artificial Sequence
  MHC class II binding epitope
SFLLPMGPSPPAE

SEQ ID NO: 374 - protein, 13 aa, Artificial Sequence
  MHC class II binding epitope
FLLPMGPSPPAEG

SEQ ID NO: 375 - protein, 13 aa, Artificial Sequence
  MHC class II binding epitope
PCIPKSFGYSSVV

SEQ ID NO: 376 - protein, 13 aa, Artificial Sequence
  MHC class II binding epitope
KSFGYSSVVCVCN

SEQ ID NO: 377 - protein, 13 aa, Artificial Sequence
  MHC class II binding epitope
FGYSSVVCVCNAT

SEQ ID NO: 378 - protein, 13 aa, Artificial Sequence
  MHC class II binding epitope
SSVVCVCNATYCD

SEQ ID NO: 379 - protein, 13 aa, Artificial Sequence
  MHC class II binding epitope
SVVCVCNATYCDS

SEQ ID NO: 380 - protein, 13 aa, Artificial Sequence
  MHC class II binding epitope
VCVCNATYCDSFD

SEQ ID NO: 381 - protein, 13 aa, Artificial Sequence
  MHC class II binding epitope
ATYCDSFDPPTFP

SEQ ID NO: 382 - protein, 13 aa, Artificial Sequence
  MHC class II binding epitope
DSFDPPTFPALGT

SEQ ID NO: 383 - protein, 13 aa, Artificial Sequence
  MHC class II binding epitope
PTFPALGTFSRYE

SEQ ID NO: 384 - protein, 13 aa, Artificial Sequence
  MHC class II binding epitope
PALGTFSRYESTR

SEQ ID NO: 385 - protein, 13 aa, Artificial Sequence
  MHC class II binding epitope
GTFSRYESTRSGR

SEQ ID NO: 386 - protein, 13 aa, Artificial Sequence
  MHC class II binding epitope
SRYESTRSGRRME

SEQ ID NO: 387 - protein, 13 aa, Artificial Sequence
  MHC class II binding epitope
GRRMELSMGPIQA

SEQ ID NO: 388 - protein, 13 aa, Artificial Sequence
  MHC class II binding epitope
RRMELSMGPIQAN

SEQ ID NO: 389 - protein, 13 aa, Artificial Sequence
  MHC class II binding epitope
RMELSMGPIQANH

SEQ ID NO: 390 - protein, 13 aa, Artificial Sequence
  MHC class II binding epitope
MELSMGPIQANHT

SEQ ID NO: 391 - protein, 13 aa, Artificial Sequence
  MHC class II binding epitope
LSMGPIQANHTGT

SEQ ID NO: 392 - protein, 13 aa, Artificial Sequence
  MHC class II binding epitope
MGPIQANHTGTGL

SEQ ID NO: 393 - protein, 13 aa, Artificial Sequence
  MHC class II binding epitope
GPIQANHTGTGLL

SEQ ID NO: 394 - protein, 13 aa, Artificial Sequence
  MHC class II binding epitope
TGLLLTLQPEQKF

SEQ ID NO: 395 - protein, 13 aa, Artificial Sequence
  MHC class II binding epitope
GLLLTLQPEQKFQ

SEQ ID NO: 396 - protein, 13 aa, Artificial Sequence
  MHC class II binding epitope
LLLTLQPEQKFQK

SEQ ID NO: 397 - protein, 13 aa, Artificial Sequence
  MHC class II binding epitope
LTLQPEQKFQKVK

SEQ ID NO: 398 - protein, 13 aa, Artificial Sequence
  MHC class II binding epitope
TLQPEQKFQKVKG

SEQ ID NO: 399 - protein, 13 aa, Artificial Sequence
  MHC class II binding epitope
PEQKFQKVKGFGG

SEQ ID NO: 400 - protein, 13 aa, Artificial Sequence
  MHC class II binding epitope
QKFQKVKGFGGAM

SEQ ID NO: 401 - protein, 13 aa, Artificial Sequence
  MHC class II binding epitope
QKVKGFGGAMTDA

SEQ ID NO: 402 - protein, 13 aa, Artificial Sequence
  MHC class II binding epitope
KGFGGAMTDAAAL

SEQ ID NO: 403 - protein, 13 aa, Artificial Sequence
  MHC class II binding epitope
GFGGAMTDAAALN

SEQ ID NO: 404 - protein, 13 aa, Artificial Sequence
  MHC class II binding epitope
GAMTDAAALNILA

SEQ ID NO: 405 - protein, 13 aa, Artificial Sequence
  MHC class II binding epitope
AMTDAAALNILAL

SEQ ID NO: 406 - protein, 13 aa, Artificial Sequence
  MHC class II binding epitope
MTDAAALNILALS

SEQ ID NO: 407 - protein, 13 aa, Artificial Sequence
  MHC class II binding epitope
AALNILALSPPAQ

SEQ ID NO: 408 - protein, 13 aa, Artificial Sequence
  MHC class II binding epitope
ALNILALSPPAQN

SEQ ID NO: 409 - protein, 13 aa, Artificial Sequence
  MHC class II binding epitope
LNILALSPPAQNL

SEQ ID NO: 410 - protein, 13 aa, Artificial Sequence
  MHC class II binding epitope
NILALSPPAQNLL

SEQ ID NO: 411 - protein, 13 aa, Artificial Sequence
  MHC class II binding epitope
LALSPPAQNLLLK

SEQ ID NO: 412 - protein, 13 aa, Artificial Sequence
  MHC class II binding epitope
ALSPPAQNLLLKS

SEQ ID NO: 413 - protein, 13 aa, Artificial Sequence
  MHC class II binding epitope
PAQNLLLKSYFSE

SEQ ID NO: 414 - protein, 13 aa, Artificial Sequence
  MHC class II binding epitope
AQNLLLKSYFSEE

SEQ ID NO: 415 - protein, 13 aa, Artificial Sequence
  MHC class II binding epitope
QNLLLKSYFSEEG

SEQ ID NO: 416 - protein, 13 aa, Artificial Sequence
  MHC class II binding epitope
NLLLKSYFSEEGI

SEQ ID NO: 417 - protein, 13 aa, Artificial Sequence
  MHC class II binding epitope
LLLKSYFSEEGIG

SEQ ID NO: 418 - protein, 13 aa, Artificial Sequence
  MHC class II binding epitope
KSYFSEEGIGYNI

SEQ ID NO: 419 - protein, 13 aa, Artificial Sequence
  MHC class II binding epitope
SYFSEEGIGYNII

SEQ ID NO: 420 - protein, 13 aa, Artificial Sequence
  MHC class II binding epitope
FSEEGIGYNIIRV

SEQ ID NO: 421 - protein, 13 aa, Artificial Sequence
  MHC class II binding epitope
EGIGYNIIRVPMA

SEQ ID NO: 422 - protein, 13 aa, Artificial Sequence
  MHC class II binding epitope
GIGYNIIRVPMAS

SEQ ID NO: 423 - protein, 13 aa, Artificial Sequence
  MHC class II binding epitope
IGYNIIRVPMASC

SEQ ID NO: 424 - protein, 13 aa, Artificial Sequence
  MHC class II binding epitope
YNIIRVPMASCDF

SEQ ID NO: 425 - protein, 13 aa, Artificial Sequence
  MHC class II binding epitope
NIIRVPMASCDFS

SEQ ID NO: 426 - protein, 13 aa, Artificial Sequence
  MHC class II binding epitope
IIRVPMASCDFSI

SEQ ID NO: 427 - protein, 13 aa, Artificial Sequence
  MHC class II binding epitope
IRVPMASCDFSIR

SEQ ID NO: 428 - protein, 13 aa, Artificial Sequence
  MHC class II binding epitope
VPMASCDFSIRTY

SEQ ID NO: 429 - protein, 13 aa, Artificial Sequence
  MHC class II binding epitope
PMASCDFSIRTYT

SEQ ID NO: 430 - protein, 13 aa, Artificial Sequence
  MHC class II binding epitope
SCDFSIRTYTYAD

SEQ ID NO: 431 - protein, 13 aa, Artificial Sequence
  MHC class II binding epitope
CDFSIRTYTYADT

SEQ ID NO: 432 - protein, 13 aa, Artificial Sequence
  MHC class II binding epitope
FSIRTYTYADTPD

SEQ ID NO: 433 - protein, 13 aa, Artificial Sequence
  MHC class II binding epitope
RTYTYADTPDDFQ

SEQ ID NO: 434 - protein, 13 aa, Artificial Sequence
  MHC class II binding epitope
TYTYADTPDDFQL

SEQ ID NO: 435 - protein, 13 aa, Artificial Sequence
  MHC class II binding epitope
YTYADTPDDFQLH

SEQ ID NO: 436 - protein, 13 aa, Artificial Sequence
  MHC class II binding epitope
ADTPDDFQLHNFS

SEQ ID NO: 437 - protein, 13 aa, Artificial Sequence
  MHC class II binding epitope
PDDFQLHNFSLPE

SEQ ID NO: 438 - protein, 13 aa, Artificial Sequence
  MHC class II binding epitope
DDFQLHNFSLPEE

SEQ ID NO: 439 - protein, 13 aa, Artificial Sequence
  MHC class II binding epitope
FQLHNFSLPEEDT

SEQ ID NO: 440 - protein, 13 aa, Artificial Sequence
  MHC class II binding epitope
HNFSLPEEDTKLK

SEQ ID NO: 441 - protein, 13 aa, Artificial Sequence
  MHC class II binding epitope
FSLPEEDTKLKIP

SEQ ID NO: 442 - protein, 13 aa, Artificial Sequence
  MHC class II binding epitope
SLPEEDTKLKIPL

SEQ ID NO: 443 - protein, 13 aa, Artificial Sequence
  MHC class II binding epitope
EEDTKLKIPLIHR

SEQ ID NO: 444 - protein, 13 aa, Artificial Sequence
  MHC class II binding epitope
TKLKIPLIHRALQ

SEQ ID NO: 445 - protein, 13 aa, Artificial Sequence
  MHC class II binding epitope
KLKIPLIHRALQL

SEQ ID NO: 446 - protein, 13 aa, Artificial Sequence
  MHC class II binding epitope
LKIPLIHRALQLA

SEQ ID NO: 447 - protein, 13 aa, Artificial Sequence
  MHC class II binding epitope
IPLIHRALQLAQR

SEQ ID NO: 448 - protein, 13 aa, Artificial Sequence
  MHC class II binding epitope
PLIHRALQLAQRP

SEQ ID NO: 449 - protein, 13 aa, Artificial Sequence
  MHC class II binding epitope
HRALQLAQRPVSL

SEQ ID NO: 450 - protein, 13 aa, Artificial Sequence
  MHC class II binding epitope
RALQLAQRPVSLL

SEQ ID NO: 451 - protein, 13 aa, Artificial Sequence
  MHC class II binding epitope
ALQLAQRPVSLLA

SEQ ID NO: 452 - protein, 13 aa, Artificial Sequence
  MHC class II binding epitope
LQLAQRPVSLLAS

SEQ ID NO: 453 - protein, 13 aa, Artificial Sequence
  MHC class II binding epitope
RPVSLLASPWTSP

SEQ ID NO: 454 - protein, 13 aa, Artificial Sequence
  MHC class II binding epitope
PVSLLASPWTSPT

SEQ ID NO: 455 - protein, 13 aa, Artificial Sequence
  MHC class II binding epitope
VSLLASPWTSPTW

SEQ ID NO: 456 - protein, 13 aa, Artificial Sequence
  MHC class II binding epitope
SLLASPWTSPTWL

SEQ ID NO: 457 - protein, 13 aa, Artificial Sequence
  MHC class II binding epitope
SPWTSPTWLKTNG

SEQ ID NO: 458 - protein, 13 aa, Artificial Sequence
  MHC class II binding epitope
TSPTWLKTNGAVN

SEQ ID NO: 459 - protein, 13 aa, Artificial Sequence
  MHC class II binding epitope
PTWLKTNGAVNGK

SEQ ID NO: 460 - protein, 13 aa, Artificial Sequence
  MHC class II binding epitope
TWLKTNGAVNGKG

SEQ ID NO: 461 - protein, 13 aa, Artificial Sequence
  MHC class II binding epitope
GAVNGKGSLKGQP

SEQ ID NO: 462 - protein, 13 aa, Artificial Sequence
  MHC class II binding epitope
GSLKGQPGDIYHQ

SEQ ID NO: 463 - protein, 13 aa, Artificial Sequence
  MHC class II binding epitope
GDIYHQTWARYFV

SEQ ID NO: 464 - protein, 13 aa, Artificial Sequence
  MHC class II binding epitope
DIYHQTWARYFVK

SEQ ID NO: 465 - protein, 13 aa, Artificial Sequence
  MHC class II binding epitope
QTWARYFVKFLDA

SEQ ID NO: 466 - protein, 13 aa, Artificial Sequence
  MHC class II binding epitope
WARYFVKFLDAYA

SEQ ID NO: 467 - protein, 13 aa, Artificial Sequence
  MHC class II binding epitope
ARYFVKFLDAYAE

SEQ ID NO: 468 - protein, 13 aa, Artificial Sequence
  MHC class II binding epitope
RYFVKFLDAYAEH

SEQ ID NO: 469 - protein, 13 aa, Artificial Sequence
  MHC class II binding epitope
YFVKFLDAYAEHK

SEQ ID NO: 470 - protein, 13 aa, Artificial Sequence
  MHC class II binding epitope
FVKFLDAYAEHKL

SEQ ID NO: 471 - protein, 13 aa, Artificial Sequence
  MHC class II binding epitope
VKFLDAYAEHKLQ

SEQ ID NO: 472 - protein, 13 aa, Artificial Sequence
  MHC class II binding epitope
KFLDAYAEHKLQF

SEQ ID NO: 473 - protein, 13 aa, Artificial Sequence
  MHC class II binding epitope
DAYAEHKLQFWAV

SEQ ID NO: 474 - protein, 13 aa, Artificial Sequence
  MHC class II binding epitope
YAEHKLQFWAVTA

SEQ ID NO: 475 - protein, 13 aa, Artificial Sequence
  MHC class II binding epitope
HKLQFWAVTAENE

SEQ ID NO: 476 - protein, 13 aa, Artificial Sequence
  MHC class II binding epitope
LQFWAVTAENEPS

SEQ ID NO: 477 - protein, 13 aa, Artificial Sequence
  MHC class II binding epitope
QFWAVTAENEPSA

SEQ ID NO: 478 - protein, 13 aa, Artificial Sequence
  MHC class II binding epitope
FWAVTAENEPSAG

SEQ ID NO: 479 - protein, 13 aa, Artificial Sequence
  MHC class II binding epitope
WAVTAENEPSAGL

SEQ ID NO: 480 - protein, 13 aa, Artificial Sequence
  MHC class II binding epitope
VTAENEPSAGLLS

SEQ ID NO: 481 - protein, 13 aa, Artificial Sequence
  MHC class II binding epitope
PSAGLLSGYPFQC

SEQ ID NO: 482 - protein, 13 aa, Artificial Sequence
  MHC class II binding epitope
AGLLSGYPFQCLG

SEQ ID NO: 483 - protein, 13 aa, Artificial Sequence
  MHC class II binding epitope
GLLSGYPFQCLGF

SEQ ID NO: 484 - protein, 13 aa, Artificial Sequence
  MHC class II binding epitope
SGYPFQCLGFTPE

SEQ ID NO: 485 - protein, 13 aa, Artificial Sequence
  MHC class II binding epitope
YPFQCLGFTPEHQ

SEQ ID NO: 486 - protein, 13 aa, Artificial Sequence
  MHC class II binding epitope
QCLGFTPEHQRDF

SEQ ID NO: 487 - protein, 13 aa, Artificial Sequence
  MHC class II binding epitope
LGFTPEHQRDFIA

SEQ ID NO: 488 - protein, 13 aa, Artificial Sequence
  MHC class II binding epitope
FTPEHQRDFIARD

SEQ ID NO: 489 - protein, 13 aa, Artificial Sequence
  MHC class II binding epitope
RDFIARDLGPTLA

SEQ ID NO: 490 - protein, 13 aa, Artificial Sequence
  MHC class II binding epitope
DFIARDLGPTLAN

SEQ ID NO: 491 - protein, 13 aa, Artificial Sequence
  MHC class II binding epitope
RDLGPTLANSTHH

SEQ ID NO: 492 - protein, 13 aa, Artificial Sequence
  MHC class II binding epitope
LGPTLANSTHHNV

SEQ ID NO: 493 - protein, 13 aa, Artificial Sequence
  MHC class II binding epitope
PTLANSTHHNVRL

SEQ ID NO: 494 - protein, 13 aa, Artificial Sequence
  MHC class II binding epitope
HNVRLLMLDDQRL

SEQ ID NO: 495 - protein, 13 aa, Artificial Sequence
  MHC class II binding epitope
VRLLMLDDQRLLL

SEQ ID NO: 496 - protein, 13 aa, Artificial Sequence
  MHC class II binding epitope
RLLMLDDQRLLLP

SEQ ID NO: 497 - protein, 13 aa, Artificial Sequence
  MHC class II binding epitope
LLMLDDQRLLLPH

SEQ ID NO: 498 - protein, 13 aa, Artificial Sequence
  MHC class II binding epitope
LMLDDQRLLLPHW

SEQ ID NO: 499 - protein, 13 aa, Artificial Sequence
  MHC class II binding epitope
DDQRLLLPHWAKV

SEQ ID NO: 500 - protein, 13 aa, Artificial Sequence
  MHC class II binding epitope
DQRLLLPHWAKVV

SEQ ID NO: 501 - protein, 13 aa, Artificial Sequence
  MHC class II binding epitope
QRLLLPHWAKVVL

SEQ ID NO: 502 - protein, 13 aa, Artificial Sequence
  MHC class II binding epitope
RLLLPHWAKVVLT

SEQ ID NO: 503 - protein, 13 aa, Artificial Sequence
  MHC class II binding epitope
LLLPHWAKVVLTD

SEQ ID NO: 504 - protein, 13 aa, Artificial Sequence
  MHC class II binding epitope
PHWAKVVLTDPEA

SEQ ID NO: 505 - protein, 13 aa, Artificial Sequence
  MHC class II binding epitope
WAKVVLTDPEAAK

SEQ ID NO: 506 - protein, 13 aa, Artificial Sequence
  MHC class II binding epitope
AKVVLTDPEAAKY

SEQ ID NO: 507 - protein, 13 aa, Artificial Sequence
  MHC class II binding epitope
KVVLTDPEAAKYV

SEQ ID NO: 508 - protein, 13 aa, Artificial Sequence
  MHC class II binding epitope
VVLTDPEAAKYVH

SEQ ID NO: 509 - protein, 13 aa, Artificial Sequence
  MHC class II binding epitope
EAAKYVHGIAVHW

SEQ ID NO: 510 - protein, 13 aa, Artificial Sequence
  MHC class II binding epitope
AKYVHGIAVHWYL

SEQ ID NO: 511 - protein, 13 aa, Artificial Sequence
  MHC class II binding epitope
KYVHGIAVHWYLD

SEQ ID NO: 512 - protein, 13 aa, Artificial Sequence
  MHC class II binding epitope
YVHGIAVHWYLDF

SEQ ID NO: 513 - protein, 13 aa, Artificial Sequence
  MHC class II binding epitope
HGIAVHWYLDFLA

SEQ ID NO: 514 - protein, 13 aa, Artificial Sequence
  MHC class II binding epitope
IAVHWYLDFLAPA

SEQ ID NO: 515 - protein, 13 aa, Artificial Sequence
  MHC class II binding epitope
VHWYLDFLAPAKA

SEQ ID NO: 516 - protein, 13 aa, Artificial Sequence
  MHC class II binding epitope
HWYLDFLAPAKAT

SEQ ID NO: 517 - protein, 13 aa, Artificial Sequence
  MHC class II binding epitope
WYLDFLAPAKATL

SEQ ID NO: 518 - protein, 13 aa, Artificial Sequence
  MHC class II binding epitope
LDFLAPAKATLGE

SEQ ID NO: 519 - protein, 13 aa, Artificial Sequence
  MHC class II binding epitope
DFLAPAKATLGET

SEQ ID NO: 520 - protein, 13 aa, Artificial Sequence
  MHC class II binding epitope
AKATHRLGETLFP

SEQ ID NO: 521 - protein, 13 aa, Artificial Sequence
  MHC class II binding epitope
ATLGETHRLFPNT

SEQ ID NO: 522 - protein, 13 aa, Artificial Sequence
  MHC class II binding epitope
GETHRLFPNTMLF

SEQ ID NO: 523 - protein, 13 aa, Artificial Sequence
  MHC class II binding epitope
ETHRLFPNTMLFA

SEQ ID NO: 524 - protein, 13 aa, Artificial Sequence
  MHC class II binding epitope
THRLFPNTMLFAS

SEQ ID NO: 525 - protein, 13 aa, Artificial Sequence
  MHC class II binding epitope
HRLFPNTMLFASE

SEQ ID NO: 526 - protein, 13 aa, Artificial Sequence
  MHC class II binding epitope
RLFPNTMLFASEA

SEQ ID NO: 527 - protein, 13 aa, Artificial Sequence
  MHC class II binding epitope
FPNTMLFASEACV

SEQ ID NO: 528 - protein, 13 aa, Artificial Sequence
  MHC class II binding epitope
NTMLFASEACVGS

SEQ ID NO: 529 - protein, 13 aa, Artificial Sequence
  MHC class II binding epitope
TMLFASEACVGSK

SEQ ID NO: 530 - protein, 13 aa, Artificial Sequence
  MHC class II binding epitope
MLFASEACVGSKF

SEQ ID NO: 531 - protein, 13 aa, Artificial Sequence
  MHC class II binding epitope
ACVGSKFWEQSVR

SEQ ID NO: 532 - protein, 13 aa, Artificial Sequence
  MHC class II binding epitope
GSKFWEQSVRLGS

SEQ ID NO: 533 - protein, 13 aa, Artificial Sequence
  MHC class II binding epitope
SKFWEQSVRLGSW

SEQ ID NO: 534 - protein, 13 aa, Artificial Sequence
  MHC class II binding epitope
KFWEQSVRLGSWD

SEQ ID NO: 535 - protein, 13 aa, Artificial Sequence
  MHC class II binding epitope
QSVRLGSWDRGMQ

SEQ ID NO: 536 - protein, 13 aa, Artificial Sequence
  MHC class II binding epitope
VRLGSWDRGMQYS

SEQ ID NO: 537 - protein, 13 aa, Artificial Sequence
  MHC class II binding epitope
RLGSWDRGMQYSH

SEQ ID NO: 538 - protein, 13 aa, Artificial Sequence
  MHC class II binding epitope
GSWDRGMQYSHSI

SEQ ID NO: 539 - protein, 13 aa, Artificial Sequence
  MHC class II binding epitope
WDRGMQYSHSIIT

SEQ ID NO: 540 - protein, 13 aa, Artificial Sequence
  MHC class II binding epitope
RGMQYSHSIITNL

SEQ ID NO: 541 - protein, 13 aa, Artificial Sequence
  MHC class II binding epitope
MQYSHSIITNLLY

SEQ ID NO: 542 - protein, 13 aa, Artificial Sequence
  MHC class II binding epitope
QYSHSIITNLLYH

SEQ ID NO: 543 - protein, 13 aa, Artificial Sequence
  MHC class II binding epitope
YSHSIITNLLYHV

SEQ ID NO: 544 - protein, 13 aa, Artificial Sequence
  MHC class II binding epitope
HSIITNLLYHVVG

SEQ ID NO: 545 - protein, 13 aa, Artificial Sequence
  MHC class II binding epitope
SIITNLLYHVVGW

SEQ ID NO: 546 - protein, 13 aa, Artificial Sequence
  MHC class II binding epitope
TNLLYHVVGWTDW

SEQ ID NO: 547 - protein, 13 aa, Artificial Sequence
  MHC class II binding epitope
NLLYHVVGWTDWN

SEQ ID NO: 548 - protein, 13 aa, Artificial Sequence
  MHC class II binding epitope
LLYHVVGWTDWNL

SEQ ID NO: 549 - protein, 13 aa, Artificial Sequence
  MHC class II binding epitope
YHVVGWTDWNLAL

SEQ ID NO: 550 - protein, 13 aa, Artificial Sequence
  MHC class II binding epitope
HVVGWTDWNLALN

SEQ ID NO: 551 - protein, 13 aa, Artificial Sequence
  MHC class II binding epitope
VVGWTDWNLALNP

SEQ ID NO: 552 - protein, 13 aa, Artificial Sequence
  MHC class II binding epitope
VGWTDWNLALNPE

SEQ ID NO: 553 - protein, 13 aa, Artificial Sequence
  MHC class II binding epitope
TDWNLALNPEGGP

SEQ ID NO: 554 - protein, 13 aa, Artificial Sequence
  MHC class II binding epitope
WNLALNPEGGPNW

SEQ ID NO: 555 - protein, 13 aa, Artificial Sequence
  MHC class II binding epitope
LALNPEGGPNWVR

SEQ ID NO: 556 - protein, 13 aa, Artificial Sequence
  MHC class II binding epitope
PNWVRNFVDSPII

SEQ ID NO: 557 - protein, 13 aa, Artificial Sequence
  MHC class II binding epitope
NWVRNFVDSPIIV

SEQ ID NO: 558 - protein, 13 aa, Artificial Sequence
  MHC class II binding epitope
RNFVDSPIIVDIT

SEQ ID NO: 559 - protein, 13 aa, Artificial Sequence
  MHC class II binding epitope
NFVDSPIIVDITK

SEQ ID NO: 560 - protein, 13 aa, Artificial Sequence
  MHC class II binding epitope
SPIIVDITKDTFY

SEQ ID NO: 561 - protein, 13 aa, Artificial Sequence
  MHC class II binding epitope
PIIVDITKDTFYK

SEQ ID NO: 562 - protein, 13 aa, Artificial Sequence
  MHC class II binding epitope
IIVDITKDTFYKQ

SEQ ID NO: 563 - protein, 13 aa, Artificial Sequence
  MHC class II binding epitope
VDITKDTFYKQPM

SEQ ID NO: 564 - protein, 13 aa, Artificial Sequence
  MHC class II binding epitope
DTFYKQPMFYHLG

SEQ ID NO: 565 - protein, 13 aa, Artificial Sequence
  MHC class II binding epitope
TFYKQPMFYHLGH

SEQ ID NO: 566 - protein, 13 aa, Artificial Sequence
  MHC class II binding epitope
QPMFYHLGHFSKF

SEQ ID NO: 567 - protein, 13 aa, Artificial Sequence
  MHC class II binding epitope
PMFYHLGHFSKFI

SEQ ID NO: 568 - protein, 13 aa, Artificial Sequence
  MHC class II binding epitope
MFYHLGHFSKFIP

SEQ ID NO: 569 - protein, 13 aa, Artificial Sequence
  MHC class II binding epitope
YHLGHFSKFIPEG

SEQ ID NO: 570 - protein, 13 aa, Artificial Sequence
  MHC class II binding epitope
GHFSKFIPEGSQR

SEQ ID NO: 571 - protein, 13 aa, Artificial Sequence
  MHC class II binding epitope
SKFIPEGSQRVGL

SEQ ID NO: 572 - protein, 13 aa, Artificial Sequence
  MHC class II binding epitope
KFIPEGSQRVGLV

SEQ ID NO: 573 - protein, 13 aa, Artificial Sequence
  MHC class II binding epitope
IPEGSQRVGLVAS

SEQ ID NO: 574 - protein, 13 aa, Artificial Sequence
  MHC class II binding epitope
QRVGLVASQKNDL

SEQ ID NO: 575 - protein, 13 aa, Artificial Sequence
  MHC class II binding epitope
VGLVASQKNDLDA

SEQ ID NO: 576 - protein, 13 aa, Artificial Sequence
  MHC class II binding epitope
GLVASQKNDLDAV

SEQ ID NO: 577 - protein, 13 aa, Artificial Sequence
  MHC class II binding epitope
SQKNDLDAVALMH

SEQ ID NO: 578 - protein, 13 aa, Artificial Sequence
  MHC class II binding epitope
NDLDAVALMHPDG

SEQ ID NO: 579 - protein, 13 aa, Artificial Sequence
  MHC class II binding epitope
DAVALMHPDGSAV

SEQ ID NO: 580 - protein, 13 aa, Artificial Sequence
  MHC class II binding epitope
VALMHPDGSAVVV

SEQ ID NO: 581 - protein, 13 aa, Artificial Sequence
  MHC class II binding epitope
ALMHPDGSAVVVV

SEQ ID NO: 582 - protein, 13 aa, Artificial Sequence
  MHC class II binding epitope
SAVVVVLNRSSKD

SEQ ID NO: 583 - protein, 13 aa, Artificial Sequence
  MHC class II binding epitope
AVVVVLNRSSKDV

SEQ ID NO: 584 - protein, 13 aa, Artificial Sequence
  MHC class II binding epitope
VVVVLNRSSKDVP

SEQ ID NO: 585 - protein, 13 aa, Artificial Sequence
  MHC class II binding epitope
VVVLNRSSKDVPL

SEQ ID NO: 586 - protein, 13 aa, Artificial Sequence
  MHC class II binding epitope
VVLNRSSKDVPLT

SEQ ID NO: 587 - protein, 13 aa, Artificial Sequence
  MHC class II binding epitope
KDVPLTIKDPAVG

SEQ ID NO: 588 - protein, 13 aa, Artificial Sequence
  MHC class II binding epitope
VPLTIKDPAVGFL

SEQ ID NO: 589 - protein, 13 aa, Artificial Sequence
  MHC class II binding epitope
PLTIKDPAVGFLE

SEQ ID NO: 590 - protein, 13 aa, Artificial Sequence
  MHC class II binding epitope
LTIKDPAVGFLET

SEQ ID NO: 591 - protein, 13 aa, Artificial Sequence
  MHC class II binding epitope
PAVGFLETISPGY

SEQ ID NO: 592 - protein, 13 aa, Artificial Sequence
  MHC class II binding epitope
VGFLETISPGYSI

SEQ ID NO: 593 - protein, 13 aa, Artificial Sequence
  MHC class II binding epitope
GFLETISPGYSIH

SEQ ID NO: 594 - protein, 13 aa, Artificial Sequence
  MHC class II binding epitope
FLETISPGYSIHT

SEQ ID NO: 595 - protein, 13 aa, Artificial Sequence
  MHC class II binding epitope
ETISPGYSIHTYL

SEQ ID NO: 596 - protein, 13 aa, Artificial Sequence
  MHC class II binding epitope
PGYSIHTYLWHRQ

SEQ ID NO: 597 - protein, 13 aa, Artificial Sequence
  MHC class II binding epitope
PGYSIHTYLWRRQ

SEQ ID NO: 598 - protein, 13 aa, Artificial Sequence
  MHC class II binding epitope
DQEDQVDPRLIDG

SEQ ID NO: 599 - protein, 13 aa, Artificial Sequence
  MHC class II binding epitope
QEDQVDPRLIDGK

SEQ ID NO: 600 - protein, 13 aa, Artificial Sequence
  MHC class II binding epitope
DQVDPRLIDGKMT

SEQ ID NO: 601 - protein, 13 aa, Artificial Sequence
  MHC class II binding epitope
QVDPRLIDGKMTR

SEQ ID NO: 602 - protein, 13 aa, Artificial Sequence
  MHC class II binding epitope
VDPRLIDGKMTRR

SEQ ID NO: 603 - protein, 13 aa, Artificial Sequence
  MHC class II binding epitope
DPRLIDGKMTRRG

SEQ ID NO: 604 - protein, 13 aa, Artificial Sequence
  MHC class II binding epitope
PRLIDGKMTRRGD

SEQ ID NO: 605 - protein, 13 aa, Artificial Sequence
  MHC class II binding epitope
RLIDGKMTRRGDS

SEQ ID NO: 606 - protein, 13 aa, Artificial Sequence
  MHC class II binding epitope
SPWQVVLLDSKKK

SEQ ID NO: 607 - protein, 13 aa, Artificial Sequence
  MHC class II binding epitope
WQVVLLDSKKKLA

SEQ ID NO: 608 - protein, 13 aa, Artificial Sequence
  MHC class II binding epitope
QVVLLDSKKKLAC

SEQ ID NO: 609 - protein, 13 aa, Artificial Sequence
  MHC class II binding epitope
VVLLDSKKKLACG

SEQ ID NO: 610 - protein, 13 aa, Artificial Sequence
  MHC class II binding epitope
VLLDSKKKLACGA

SEQ ID NO: 611 - protein, 13 aa, Artificial Sequence
  MHC class II binding epitope
DSKKKLACGAVLI

SEQ ID NO: 612 - protein, 13 aa, Artificial Sequence
  MHC class II binding epitope
SKKKLACGAVLIH

SEQ ID NO: 613 - protein, 13 aa, Artificial Sequence
  MHC class II binding epitope
KKLACGAVLIHPS

SEQ ID NO: 614 - protein, 13 aa, Artificial Sequence
  MHC class II binding epitope
CGAVLIHPSWVLT

SEQ ID NO: 615 - protein, 13 aa, Artificial Sequence
  MHC class II binding epitope
GAVLIHPSWVLTA

SEQ ID NO: 616 - protein, 13 aa, Artificial Sequence
  MHC class II binding epitope
VLIHPSWVLTAAH

SEQ ID NO: 617 - protein, 13 aa, Artificial Sequence
  MHC class II binding epitope
PSWVLTAAHCMDE

SEQ ID NO: 618 - protein, 13 aa, Artificial Sequence
  MHC class II binding epitope
SWVLTAAHCMDES

SEQ ID NO: 619 - protein, 13 aa, Artificial Sequence
  MHC class II binding epitope
WVLTAAHCMDESK

SEQ ID NO: 620 - protein, 13 aa, Artificial Sequence
  MHC class II binding epitope
AAHCMDESKKLLV

SEQ ID NO: 621 - protein, 13 aa, Artificial Sequence
  MHC class II binding epitope
HCMDESKKLLVRL

SEQ ID NO: 622 - protein, 13 aa, Artificial Sequence
  MHC class II binding epitope
SKKLLVRLGEYDL

SEQ ID NO: 623 - protein, 13 aa, Artificial Sequence
  MHC class II binding epitope
KKLLVRLGEYDLR

SEQ ID NO: 624 - protein, 13 aa, Artificial Sequence
  MHC class II binding epitope
KLLVRLGEYDLRR

SEQ ID NO: 625 - protein, 13 aa, Artificial Sequence
  MHC class II binding epitope
LLVRLGEYDLRRW

SEQ ID NO: 626 - protein, 13 aa, Artificial Sequence
  MHC class II binding epitope
VRLGEYDLRRWEK

SEQ ID NO: 627 - protein, 13 aa, Artificial Sequence
  MHC class II binding epitope
RLGEYDLRRWEKW

SEQ ID NO: 628 - protein, 13 aa, Artificial Sequence
  MHC class II binding epitope
LGEYDLRRWEKWE

SEQ ID NO: 629 - protein, 13 aa, Artificial Sequence
  MHC class II binding epitope
GEYDLRRWEKWEL

SEQ ID NO: 630 - protein, 13 aa, Artificial Sequence
  MHC class II binding epitope
YDLRRWEKWELDL

SEQ ID NO: 631 - protein, 13 aa, Artificial Sequence
  MHC class II binding epitope
RRWEKWELDLDIK

SEQ ID NO: 632 - protein, 13 aa, Artificial Sequence
  MHC class II binding epitope
EKWELDLDIKEVF

SEQ ID NO: 633 - protein, 13 aa, Artificial Sequence
  MHC class II binding epitope
WELDLDIKEVFVH

SEQ ID NO: 634 - protein, 13 aa, Artificial Sequence
  MHC class II binding epitope
LDLDIKEVFVHPN

SEQ ID NO: 635 - protein, 13 aa, Artificial Sequence
  MHC class II binding epitope
LDIKEVFVHPNYS

SEQ ID NO: 636 - protein, 13 aa, Artificial Sequence
  MHC class II binding epitope
IKEVFVHPNYSKS

SEQ ID NO: 637 - protein, 13 aa, Artificial Sequence
  MHC class II binding epitope
KEVFVHPNYSKST

SEQ ID NO: 638 - protein, 13 aa, Artificial Sequence
  MHC class II binding epitope
EVFVHPNYSKSTT

SEQ ID NO: 639 - protein, 13 aa, Artificial Sequence
  MHC class II binding epitope
VFVHPNYSKSTTD

SEQ ID NO: 640 - protein, 13 aa, Artificial Sequence
  MHC class II binding epitope
PNYSKSTTDNDIA

SEQ ID NO: 641 - protein, 13 aa, Artificial Sequence
  MHC class II binding epitope
SKSTTDNDIALLH

SEQ ID NO: 642 - protein, 13 aa, Artificial Sequence
  MHC class II binding epitope
TTDNDIALLHLAQ

SEQ ID NO: 643 - protein, 13 aa, Artificial Sequence
  MHC class II binding epitope
TDNDIALLHLAQP

SEQ ID NO: 644 - protein, 13 aa, Artificial Sequence
  MHC class II binding epitope
DNDIALLHLAQPA

SEQ ID NO: 645 - protein, 13 aa, Artificial Sequence
  MHC class II binding epitope
NDIALLHLAQPAT

SEQ ID NO: 646 - protein, 13 aa, Artificial Sequence
  MHC class II binding epitope
IALLHLAQPATLS

SEQ ID NO: 647 - protein, 13 aa, Artificial Sequence
  MHC class II binding epitope
ALLHLAQPATLSQ

SEQ ID NO: 648 - protein, 13 aa, Artificial Sequence
  MHC class II binding epitope
LHLAQPATLSQTI

SEQ ID NO: 649 - protein, 13 aa, Artificial Sequence
  MHC class II binding epitope
AQPATLSQTIVPI

SEQ ID NO: 650 - protein, 13 aa, Artificial Sequence
  MHC class II binding epitope
PATLSQTIVPICL

SEQ ID NO: 651 - protein, 13 aa, Artificial Sequence
  MHC class II binding epitope
ATLSQTIVPICLP

SEQ ID NO: 652 - protein, 13 aa, Artificial Sequence
  MHC class II binding epitope
TLSQTIVPICLPD

SEQ ID NO: 653 - protein, 13 aa, Artificial Sequence
  MHC class II binding epitope
QTIVPICLPDSGL

SEQ ID NO: 654 - protein, 13 aa, Artificial Sequence
  MHC class II binding epitope
TIVPICLPDSGLA

SEQ ID NO: 655 - protein, 13 aa, Artificial Sequence
  MHC class II binding epitope
IVPICLPDSGLAE

SEQ ID NO: 656 - protein, 13 aa, Artificial Sequence
  MHC class II binding epitope
VPICLPDSGLAER

SEQ ID NO: 657 - protein, 13 aa, Artificial Sequence
  MHC class II binding epitope
ICLPDSGLAEREL

SEQ ID NO: 658 - protein, 13 aa, Artificial Sequence
  MHC class II binding epitope
PDSGLAERELNQA

SEQ ID NO: 659 - protein, 13 aa, Artificial Sequence
  MHC class II binding epitope
SGLAERELNQAGQ

SEQ ID NO: 660 - protein, 13 aa, Artificial Sequence
  MHC class II binding epitope
GLAERELNQAGQE

SEQ ID NO: 661 - protein, 13 aa, Artificial Sequence
  MHC class II binding epitope
LAERELNQAGQET

SEQ ID NO: 662 - protein, 13 aa, Artificial Sequence
  MHC class II binding epitope
RELNQAGQETLVT

SEQ ID NO: 663 - protein, 13 aa, Artificial Sequence
  MHC class II binding epitope
GQETLVTGWGYHS

SEQ ID NO: 664 - protein, 13 aa, Artificial Sequence
  MHC class II binding epitope
ETLVTGWGYHSSR

SEQ ID NO: 665 - protein, 13 aa, Artificial Sequence
  MHC class II binding epitope
TLVTGWGYHSSRE

SEQ ID NO: 666 - protein, 13 aa, Artificial Sequence
  MHC class II binding epitope
TGWGYHSSREKEA

SEQ ID NO: 667 - protein, 13 aa, Artificial Sequence
  MHC class II binding epitope
WGYHSSREKEAKR

SEQ ID NO: 668 - protein, 13 aa, Artificial Sequence
  MHC class II binding epitope
WGYHSSREKEAKR

SEQ ID NO: 669 - protein, 13 aa, Artificial Sequence
  MHC class II binding epitope
SREKEAKRNRTFV

SEQ ID NO: 670 - protein, 13 aa, Artificial Sequence
  MHC class II binding epitope
RNRTFVLNFIKIP

SEQ ID NO: 671 - protein, 13 aa, Artificial Sequence
  MHC class II binding epitope
NRTFVLNFIKIPV

SEQ ID NO: 672 - protein, 13 aa, Artificial Sequence
  MHC class II binding epitope
RTFVLNFIKIPVV

SEQ ID NO: 673 - protein, 13 aa, Artificial Sequence
  MHC class II binding epitope
TFVLNFIKIPVVP

SEQ ID NO: 674 - protein, 13 aa, Artificial Sequence
  MHC class II binding epitope
FVLNFIKIPVVPH

SEQ ID NO: 675 - protein, 13 aa, Artificial Sequence
  MHC class II binding epitope
LNFIKIPVVPHNE

SEQ ID NO: 676 - protein, 13 aa, Artificial Sequence
  MHC class II binding epitope
NFIKIPVVPHNEC

SEQ ID NO: 677 - protein, 13 aa, Artificial Sequence
  MHC class II binding epitope
IKIPVVPHNECSE

SEQ ID NO: 678 - protein, 13 aa, Artificial Sequence
  MHC class II binding epitope
IPVVPHNECSEVM

SEQ ID NO: 679 - protein, 13 aa, Artificial Sequence
  MHC class II binding epitope
PVVPHNECSEVMS

SEQ ID NO: 680 - protein, 13 aa, Artificial Sequence
  MHC class II binding epitope
VVPHNECSEVMSN

SEQ ID NO: 681 - protein, 13 aa, Artificial Sequence
  MHC class II binding epitope
NECSEVMSNMVSE

SEQ ID NO: 682 - protein, 13 aa, Artificial Sequence
  MHC class II binding epitope
SEVMSNMVSENML

SEQ ID NO: 683 - protein, 13 aa, Artificial Sequence
  MHC class II binding epitope
EVMSNMVSENMLC

SEQ ID NO: 684 - protein, 13 aa, Artificial Sequence
  MHC class II binding epitope
VMSNMVSENMLCA

SEQ ID NO: 685 - protein, 13 aa, Artificial Sequence
  MHC class II binding epitope
SNMVSENMLCAGI

SEQ ID NO: 686 - protein, 13 aa, Artificial Sequence
  MHC class II binding epitope
MVSENMLCAGILG

SEQ ID NO: 687 - protein, 13 aa, Artificial Sequence
  MHC class II binding epitope
VSENMLCAGILGD

SEQ ID NO: 688 - protein, 13 aa, Artificial Sequence
  MHC class II binding epitope
ENMLCAGILGDRQ

SEQ ID NO: 689 - protein, 13 aa, Artificial Sequence
  MHC class II binding epitope
NMLCAGILGDRQD

SEQ ID NO: 690 - protein, 13 aa, Artificial Sequence
  MHC class II binding epitope
AGILGDRQDACEG

SEQ ID NO: 691 - protein, 13 aa, Artificial Sequence
  MHC class II binding epitope
GILGDRQDACEGD

SEQ ID NO: 692 - protein, 13 aa, Artificial Sequence
  MHC class II binding epitope
GPMVASFHGTWFL

SEQ ID NO: 693 - protein, 13 aa, Artificial Sequence
  MHC class II binding epitope
PMVASFHGTWFLV

SEQ ID NO: 694 - protein, 13 aa, Artificial Sequence
  MHC class II binding epitope
MVASFHGTWFLVG

SEQ ID NO: 695 - protein, 13 aa, Artificial Sequence
  MHC class II binding epitope
ASFHGTWFLVGLV

SEQ ID NO: 696 - protein, 13 aa, Artificial Sequence
  MHC class II binding epitope
GTWFLVGLVSWGE

SEQ ID NO: 697 - protein, 13 aa, Artificial Sequence
  MHC class II binding epitope
TWFLVGLVSWGEG

SEQ ID NO: 698 - protein, 13 aa, Artificial Sequence
  MHC class II binding epitope
WFLVGLVSWGEGC

SEQ ID NO: 699 - protein, 13 aa, Artificial Sequence
  MHC class II binding epitope
FLVGLVSWGEGCG

SEQ ID NO: 700 - protein, 13 aa, Artificial Sequence
  MHC class II binding epitope
VGLVSWGEGCGLL

SEQ ID NO: 701 - protein, 13 aa, Artificial Sequence
  MHC class II binding epitope
GLVSWGEGCGLLH

SEQ ID NO: 702 - protein, 13 aa, Artificial Sequence
  MHC class II binding epitope
VSWGEGCGLLHNY

SEQ ID NO: 703 - protein, 13 aa, Artificial Sequence
  MHC class II binding epitope
EGCGLLHNYGVYT

SEQ ID NO: 704 - protein, 13 aa, Artificial Sequence
  MHC class II binding epitope
CGLLHNYGVYTKV

SEQ ID NO: 705 - protein, 13 aa, Artificial Sequence
  MHC class II binding epitope
GLLHNYGVYTKVS

SEQ ID NO: 706 - protein, 13 aa, Artificial Sequence
  MHC class II binding epitope
LHNYGVYTKVSRY

SEQ ID NO: 707 - protein, 13 aa, Artificial Sequence
  MHC class II binding epitope
HNYGVYTKVSRYL

SEQ ID NO: 708 - protein, 13 aa, Artificial Sequence
  MHC class II binding epitope
YGVYTKVSRYLDW

SEQ ID NO: 709 - protein, 13 aa, Artificial Sequence
  MHC class II binding epitope
GVYTKVSRYLDWI

SEQ ID NO: 710 - protein, 13 aa, Artificial Sequence
  MHC class II binding epitope
TKVSRYLDWIHGH

SEQ ID NO: 711 - protein, 13 aa, Artificial Sequence
  MHC class II binding epitope
SRYLDWIHGHIRD

SEQ ID NO: 712 - protein, 13 aa, Artificial Sequence
  MHC class II binding epitope
RYLDWIHGHIRDK

SEQ ID NO: 713 - protein, 13 aa, Artificial Sequence
  MHC class II binding epitope
LDWIHGHIRDKEA

SEQ ID NO: 714 - protein, 13 aa, Artificial Sequence
  MHC class II binding epitope
DWIHGHIRDKEAP

SEQ ID NO: 715 - protein, 13 aa, Artificial Sequence
  MHC class II binding epitope
HGHIRDKEAPQKS

SEQ ID NO: 716 - protein, 13 aa, Artificial Sequence
  MHC class II binding epitope
GHIRDKEAPQKSW

SEQ ID NO: 717 - protein, 13 aa, Artificial Sequence
  MHC class II binding epitope
NSFLEELRHSSLE

SEQ ID NO: 718 - protein, 13 aa, Artificial Sequence
  MHC class II binding epitope
SFLEELRHSSLER

SEQ ID NO: 719 - protein, 13 aa, Artificial Sequence
  MHC class II binding epitope
EELRHSSLERECI

SEQ ID NO: 720 - protein, 13 aa, Artificial Sequence
  MHC class II binding epitope
LRHSSLERECIEE

SEQ ID NO: 721 - protein, 13 aa, Artificial Sequence
  MHC class II binding epitope
SSLERECIEEICD

SEQ ID NO: 722 - protein, 13 aa, Artificial Sequence
  MHC class II binding epitope
ECIEEICDFEEAK

SEQ ID NO: 723 - protein, 13 aa, Artificial Sequence
  MHC class II binding epitope
IEEICDFEEAKEI

SEQ ID NO: 724 - protein, 13 aa, Artificial Sequence
  MHC class II binding epitope
EEICDFEEAKEIF

SEQ ID NO: 725 - protein, 13 aa, Artificial Sequence
  MHC class II binding epitope
EICDFEEAKEIFQ

SEQ ID NO: 726 - protein, 13 aa, Artificial Sequence
  MHC class II binding epitope
CDFEEAKEIFQNV

SEQ ID NO: 727 - protein, 13 aa, Artificial Sequence
  MHC class II binding epitope
KEIFQNVDDTLAF

SEQ ID NO: 728 - protein, 13 aa, Artificial Sequence
  MHC class II binding epitope
EIFQNVDDTLAFW

SEQ ID NO: 729 - protein, 13 aa, Artificial Sequence
  MHC class II binding epitope
IFQNVDDTLAFWS

SEQ ID NO: 730 - protein, 13 aa, Artificial Sequence
  MHC class II binding epitope
QNVDDTLAFWSKH

SEQ ID NO: 731 - protein, 13 aa, Artificial Sequence
  MHC class II binding epitope
DDTLAFWSKHVDG

SEQ ID NO: 732 - protein, 13 aa, Artificial Sequence
  MHC class II binding epitope
DTLAFWSKHVDGD

SEQ ID NO: 733 - protein, 13 aa, Artificial Sequence
  MHC class II binding epitope
LAFWSKHVDGDQC

SEQ ID NO: 734 - protein, 13 aa, Artificial Sequence
  MHC class II binding epitope
AFWSKHVDGDQCL

SEQ ID NO: 735 - protein, 13 aa, Artificial Sequence
  MHC class II binding epitope
WSKHVDGDQCLVL

SEQ ID NO: 736 - protein, 13 aa, Artificial Sequence
  MHC class II binding epitope
KHVDGDQCLVLPL

SEQ ID NO: 737 - protein, 13 aa, Artificial Sequence
  MHC class II binding epitope
QCLVLPLEHPCAS

SEQ ID NO: 738 - protein, 13 aa, Artificial Sequence
  MHC class II binding epitope
CLVLPLEHPCASL

SEQ ID NO: 739 - protein, 13 aa, Artificial Sequence
  MHC class II binding epitope
LVLPLEHPCASLC

SEQ ID NO: 740 - protein, 13 aa, Artificial Sequence
  MHC class II binding epitope
LPLEHPCASLCCG

SEQ ID NO: 741 - protein, 13 aa, Artificial Sequence
  MHC class II binding epitope
ASLCCGHGTCIDG

SEQ ID NO: 742 - protein, 13 aa, Artificial Sequence
  MHC class II binding epitope
HGTCIDGIGSFSC

SEQ ID NO: 743 - protein, 13 aa, Artificial Sequence
  MHC class II binding epitope
TCIDGIGSFSCDC

SEQ ID NO: 744 - protein, 13 aa, Artificial Sequence
  MHC class II binding epitope
DGIGSFSCDCRSG

SEQ ID NO: 745 - protein, 13 aa, Artificial Sequence
  MHC class II binding epitope
GSFSCDCRSGWEG

SEQ ID NO: 746 - protein, 13 aa, Artificial Sequence
  MHC class II binding epitope
CRSGWEGRFCQRE

SEQ ID NO: 747 - protein, 13 aa, Artificial Sequence
  MHC class II binding epitope
SGWEGRFCQREVS

SEQ ID NO: 748 - protein, 13 aa, Artificial Sequence
  MHC class II binding epitope
GWEGRFCQREVSF

SEQ ID NO: 749 - protein, 13 aa, Artificial Sequence
  MHC class II binding epitope
GRFCQREVSFLNC

SEQ ID NO: 750 - protein, 13 aa, Artificial Sequence
  MHC class II binding epitope
RFCQREVSFLNCS

SEQ ID NO: 751 - protein, 13 aa, Artificial Sequence
  MHC class II binding epitope
QREVSFLNCSLDN

SEQ ID NO: 752 - protein, 13 aa, Artificial Sequence
  MHC class II binding epitope
REVSFLNCSLDNG

SEQ ID NO: 753 - protein, 13 aa, Artificial Sequence
  MHC class II binding epitope
VSFLNCSLDNGGC

SEQ ID NO: 754 - protein, 13 aa, Artificial Sequence
  MHC class II binding epitope
SFLNCSLDNGGCT

SEQ ID NO: 755 - protein, 13 aa, Artificial Sequence
  MHC class II binding epitope
CSLDNGGCTHYCL

SEQ ID NO: 756 - protein, 13 aa, Artificial Sequence
  MHC class II binding epitope
THYCLEEVGWRRC

SEQ ID NO: 757 - protein, 13 aa, Artificial Sequence
  MHC class II binding epitope
YCLEEVGWRRCSC

SEQ ID NO: 758 - protein, 13 aa, Artificial Sequence
  MHC class II binding epitope
EEVGWRRCSCAPG

SEQ ID NO: 759 - protein, 13 aa, Artificial Sequence
  MHC class II binding epitope
VGWRRCSCAPGYK

SEQ ID NO: 760 - protein, 13 aa, Artificial Sequence
  MHC class II binding epitope
RRCSCAPGYKLGD

SEQ ID NO: 761 - protein, 13 aa, Artificial Sequence
  MHC class II binding epitope
APGYKLGDDLLQC

SEQ ID NO: 762 - protein, 13 aa, Artificial Sequence
  MHC class II binding epitope
PGYKLGDDLLQCH

SEQ ID NO: 763 - protein, 13 aa, Artificial Sequence
  MHC class II binding epitope
YKLGDDLLQCHPA

SEQ ID NO: 764 - protein, 13 aa, Artificial Sequence
  MHC class II binding epitope
LGDDLLQCHPAVK

SEQ ID NO: 765 - protein, 13 aa, Artificial Sequence
  MHC class II binding epitope
GDDLLQCHPAVKF

SEQ ID NO: 766 - protein, 13 aa, Artificial Sequence
  MHC class II binding epitope
DDLLQCHPAVKFP

SEQ ID NO: 767 - protein, 13 aa, Artificial Sequence
  MHC class II binding epitope
DLLQCHPAVKFPC

SEQ ID NO: 768 - protein, 13 aa, Artificial Sequence
  MHC class II binding epitope
PAVKFPCGRPWKR

SEQ ID NO: 769 - protein, 13 aa, Artificial Sequence
  MHC class II binding epitope
VKFPCGRPWKRME

SEQ ID NO: 770 - protein, 13 aa, Artificial Sequence
  MHC class II binding epitope
RPWKRMEKKRSHL

SEQ ID NO: 771 - protein, 13 aa, Artificial Sequence
  MHC class II binding epitope
QSVPWGISRVQAP

SEQ ID NO: 772 - protein, 13 aa, Artificial Sequence
  MHC class II binding epitope
SVPWGISRVQAPA

SEQ ID NO: 773 - protein, 13 aa, Artificial Sequence
  MHC class II binding epitope
WGISRVQAPAAHN

SEQ ID NO: 774 - protein, 13 aa, Artificial Sequence
  MHC class II binding epitope
SRVQAPAAHNRGL

SEQ ID NO: 775 - protein, 13 aa, Artificial Sequence
  MHC class II binding epitope
VQAPAAHNRGLTG

SEQ ID NO: 776 - protein, 13 aa, Artificial Sequence
  MHC class II binding epitope
AHNRGLTGSGVKV

SEQ ID NO: 777 - protein, 13 aa, Artificial Sequence
  MHC class II binding epitope
RGLTGSGVKVAVL

SEQ ID NO: 778 - protein, 13 aa, Artificial Sequence
  MHC class II binding epitope
SGVKVAVLDTGIS

SEQ ID NO: 779 - protein, 13 aa, Artificial Sequence
  MHC class II binding epitope
GVKVAVLDTGIST

SEQ ID NO: 780 - protein, 13 aa, Artificial Sequence
  MHC class II binding epitope
VKVAVLDTGISTH

SEQ ID NO: 781 - protein, 13 aa, Artificial Sequence
  MHC class II binding epitope
VAVLDTGISTHPD

SEQ ID NO: 782 - protein, 13 aa, Artificial Sequence
  MHC class II binding epitope
AVLDTGISTHPDL

SEQ ID NO: 783 - protein, 13 aa, Artificial Sequence
  MHC class II binding epitope
TGISTHPDLNIRG

SEQ ID NO: 784 - protein, 13 aa, Artificial Sequence
  MHC class II binding epitope
ISTHPDLNIRGGA

SEQ ID NO: 785 - protein, 13 aa, Artificial Sequence
  MHC class II binding epitope
HPDLNIRGGASFV

SEQ ID NO: 786 - protein, 13 aa, Artificial Sequence
  MHC class II binding epitope
PDLNIRGGASFVP

SEQ ID NO: 787 - protein, 13 aa, Artificial Sequence
  MHC class II binding epitope
LNIRGGASFVPGE

SEQ ID NO: 788 - protein, 13 aa, Artificial Sequence
  MHC class II binding epitope
ASFVPGEPSTQDG

SEQ ID NO: 789 - protein, 13 aa, Artificial Sequence
  MHC class II binding epitope
SFVPGEPSTQDGN

SEQ ID NO: 790 - protein, 13 aa, Artificial Sequence
  MHC class II binding epitope
EPSTQDGNGHGTH

SEQ ID NO: 791 - protein, 13 aa, Artificial Sequence
  MHC class II binding epitope
GHGTHVAGTIAAL

SEQ ID NO: 792 - protein, 13 aa, Artificial Sequence
  MHC class II binding epitope
HGTHVAGTIAALN

SEQ ID NO: 793 - protein, 13 aa, Artificial Sequence
  MHC class II binding epitope
THVAGTIAALNNS

SEQ ID NO: 794 - protein, 13 aa, Artificial Sequence
  MHC class II binding epitope
AGTIAALNNSIGV

SEQ ID NO: 795 - protein, 13 aa, Artificial Sequence
  MHC class II binding epitope
GTIAALNNSIGVL

SEQ ID NO: 796 - protein, 13 aa, Artificial Sequence
  MHC class II binding epitope
AALNNSIGVLGVA

SEQ ID NO: 797 - protein, 13 aa, Artificial Sequence
  MHC class II binding epitope
ALNNSIGVLGVAP

SEQ ID NO: 798 - protein, 13 aa, Artificial Sequence
  MHC class II binding epitope
NSIGVLGVAPSAE

SEQ ID NO: 799 - protein, 13 aa, Artificial Sequence
  MHC class II binding epitope
GVLGVAPSAELYA

SEQ ID NO: 800 - protein, 13 aa, Artificial Sequence
  MHC class II binding epitope
LGVAPSAELYAVK

SEQ ID NO: 801 - protein, 13 aa, Artificial Sequence
  MHC class II binding epitope
APSAELYAVKVLG

SEQ ID NO: 802 - protein, 13 aa, Artificial Sequence
  MHC class II binding epitope
AELYAVKVLGASG

SEQ ID NO: 803 - protein, 13 aa, Artificial Sequence
  MHC class II binding epitope
ELYAVKVLGASGS

SEQ ID NO: 804 - protein, 13 aa, Artificial Sequence
  MHC class II binding epitope
YAVKVLGASGSGS

SEQ ID NO: 805 - protein, 13 aa, Artificial Sequence
  MHC class II binding epitope
VKVLGASGSGSVS

SEQ ID NO: 806 - protein, 13 aa, Artificial Sequence
  MHC class II binding epitope
KVLGASGSGSVSS

SEQ ID NO: 807 - protein, 13 aa, Artificial Sequence
  MHC class II binding epitope
SGSGSVSSIAQGL

SEQ ID NO: 808 - protein, 13 aa, Artificial Sequence
  MHC class II binding epitope
SGSVSSIAQGLEW

SEQ ID NO: 809 - protein, 13 aa, Artificial Sequence
  MHC class II binding epitope
GSVSSIAQGLEWA

SEQ ID NO: 810 - protein, 13 aa, Artificial Sequence
  MHC class II binding epitope
SSIAQGLEWAGNN

SEQ ID NO: 811 - protein, 13 aa, Artificial Sequence
  MHC class II binding epitope
QGLEWAGNNGMHV

SEQ ID NO: 812 - protein, 13 aa, Artificial Sequence
  MHC class II binding epitope
LEWAGNNGMHVAN

SEQ ID NO: 813 - protein, 13 aa, Artificial Sequence
  MHC class II binding epitope
NNGMHVANLSLGS

SEQ ID NO: 814 - protein, 13 aa, Artificial Sequence
  MHC class II binding epitope
NGMHVANLSLGSP

SEQ ID NO: 815 - protein, 13 aa, Artificial Sequence
  MHC class II binding epitope
MHVANLSLGSPSP

SEQ ID NO: 816 - protein, 13 aa, Artificial Sequence
  MHC class II binding epitope
HVANLSLGSPSPS

SEQ ID NO: 817 - protein, 13 aa, Artificial Sequence
  MHC class II binding epitope
VANLSLGSPSPSA

SEQ ID NO: 818 - protein, 13 aa, Artificial Sequence
  MHC class II binding epitope
ANLSLGSPSPSAT

SEQ ID NO: 819 - protein, 13 aa, Artificial Sequence
  MHC class II binding epitope
LSLGSPSPSATLE

SEQ ID NO: 820 - protein, 13 aa, Artificial Sequence
  MHC class II binding epitope
SPSPSATLEQAVN

SEQ ID NO: 821 - protein, 13 aa, Artificial Sequence
  MHC class II binding epitope
SPSATLEQAVNSA

SEQ ID NO: 822 - protein, 13 aa, Artificial Sequence
  MHC class II binding epitope
PSATLEQAVNSAT

SEQ ID NO: 823 - protein, 13 aa, Artificial Sequence
  MHC class II binding epitope
ATLEQAVNSATSR

SEQ ID NO: 824 - protein, 13 aa, Artificial Sequence
  MHC class II binding epitope
TLEQAVNSATSRG

SEQ ID NO: 825 - protein, 13 aa, Artificial Sequence
  MHC class II binding epitope
QAVNSATSRGVLV

SEQ ID NO: 826 - protein, 13 aa, Artificial Sequence
  MHC class II binding epitope
RGVLVVAASGNSG

SEQ ID NO: 827 - protein, 13 aa, Artificial Sequence
  MHC class II binding epitope
GVLVVAASGNSGA

SEQ ID NO: 828 - protein, 13 aa, Artificial Sequence
  MHC class II binding epitope
VLVVAASGNSGAG

SEQ ID NO: 829 - protein, 13 aa, Artificial Sequence
  MHC class II binding epitope
LVVAASGNSGAGS

SEQ ID NO: 830 - protein, 13 aa, Artificial Sequence
  MHC class II binding epitope
VAASGNSGAGSIS

SEQ ID NO: 831 - protein, 13 aa, Artificial Sequence
  MHC class II binding epitope
GSISYPARYANAM

SEQ ID NO: 832 - protein, 13 aa, Artificial Sequence
  MHC class II binding epitope
ISYPARYANAMAV

SEQ ID NO: 833 - protein, 13 aa, Artificial Sequence
  MHC class II binding epitope
YPARYANAMAVGA

SEQ ID NO: 834 - protein, 13 aa, Artificial Sequence
  MHC class II binding epitope
ARYANAMAVGATD

SEQ ID NO: 835 - protein, 13 aa, Artificial Sequence
  MHC class II binding epitope
NAMAVGATDQNNN

SEQ ID NO: 836 - protein, 13 aa, Artificial Sequence
  MHC class II binding epitope
MAVGATDQNNNRA

SEQ ID NO: 837 - protein, 13 aa, Artificial Sequence
  MHC class II binding epitope
AVGATDQNNNRAS

SEQ ID NO: 838 - protein, 13 aa, Artificial Sequence
  MHC class II binding epitope
NNRASFSQYGAGL

SEQ ID NO: 839 - protein, 13 aa, Artificial Sequence
  MHC class II binding epitope
RASFSQYGAGLDI

SEQ ID NO: 840 - protein, 13 aa, Artificial Sequence
  MHC class II binding epitope
ASFSQYGAGLDIV

SEQ ID NO: 841 - protein, 13 aa, Artificial Sequence
  MHC class II binding epitope
SQYGAGLDIVAPG

SEQ ID NO: 842 - protein, 13 aa, Artificial Sequence
  MHC class II binding epitope
GAGLDIVAPGVNV

SEQ ID NO: 843 - protein, 13 aa, Artificial Sequence
  MHC class II binding epitope
AGLDIVAPGVNVQ

SEQ ID NO: 844 - protein, 13 aa, Artificial Sequence
  MHC class II binding epitope
LDIVAPGVNVQST

SEQ ID NO: 845 - protein, 13 aa, Artificial Sequence
  MHC class II binding epitope
DIVAPGVNVQSTY

SEQ ID NO: 846 - protein, 13 aa, Artificial Sequence
  MHC class II binding epitope
APGVNVQSTYPGS

SEQ ID NO: 847 - protein, 13 aa, Artificial Sequence
  MHC class II binding epitope
PGVNVQSTYPGST

SEQ ID NO: 848 - protein, 13 aa, Artificial Sequence
  MHC class II binding epitope
VNVQSTYPGSTYA

SEQ ID NO: 849 - protein, 13 aa, Artificial Sequence
  MHC class II binding epitope
STYPGSTYASLNG

SEQ ID NO: 850 - protein, 13 aa, Artificial Sequence
  MHC class II binding epitope
STYASLNGTSMAT

SEQ ID NO: 851 - protein, 13 aa, Artificial Sequence
  MHC class II binding epitope
ASLNGTSMATPHV

SEQ ID NO: 852 - protein, 13 aa, Artificial Sequence
  MHC class II binding epitope
NGTSMATPHVAGA

SEQ ID NO: 853 - protein, 13 aa, Artificial Sequence
  MHC class II binding epitope
MATPHVAGAAALV

SEQ ID NO: 854 - protein, 13 aa, Artificial Sequence
  MHC class II binding epitope
TSMATPHVAGAAA

SEQ ID NO: 855 - protein, 13 aa, Artificial Sequence
  MHC class II binding epitope
PHVAGAAALVKQK

SEQ ID NO: 856 - protein, 13 aa, Artificial Sequence
  MHC class II binding epitope
AALVKQKNPSWSN

SEQ ID NO: 857 - protein, 13 aa, Artificial Sequence
  MHC class II binding epitope
ALVKQKNPSWSNV

SEQ ID NO: 858 - protein, 13 aa, Artificial Sequence
  MHC class II binding epitope
PSWSNVQIRNHLK

SEQ ID NO: 859 - protein, 13 aa, Artificial Sequence
  MHC class II binding epitope
WSNVQIRNHLKNT

SEQ ID NO: 860 - protein, 13 aa, Artificial Sequence
  MHC class II binding epitope
SNVQIRNHLKNTA

SEQ ID NO: 861 - protein, 13 aa, Artificial Sequence
  MHC class II binding epitope
VQIRNHLKNTATS

SEQ ID NO: 862 - protein, 13 aa, Artificial Sequence
  MHC class II binding epitope
QIRNHLKNTATSL

SEQ ID NO: 863 - protein, 13 aa, Artificial Sequence
  MHC class II binding epitope
RNHLKNTATSLGS

SEQ ID NO: 864 - protein, 13 aa, Artificial Sequence
  MHC class II binding epitope
NHLKNTATSLGST

SEQ ID NO: 865 - protein, 13 aa, Artificial Sequence
  MHC class II binding epitope
HLKNTATSLGSTN

SEQ ID NO: 866 - protein, 13 aa, Artificial Sequence
  MHC class II binding epitope
ATSLGSTNLYGSG

SEQ ID NO: 867 - protein, 13 aa, Artificial Sequence
  MHC class II binding epitope
TSLGSTNLYGSGL

SEQ ID NO: 868 - protein, 13 aa, Artificial Sequence
  MHC class II binding epitope
LGSTNLYGSGLVN

SEQ ID NO: 869 - protein, 13 aa, Artificial Sequence
  MHC class II binding epitope
TNLYGSGLVNAEA

SEQ ID NO: 870 - protein, 13 aa, Artificial Sequence
  MHC class II binding epitope
NLYGSGLVNAEAA

SEQ ID NO: 871 - protein, 13 aa, Artificial Sequence
  MHC class II binding epitope
LYGSGLVNAEAAT

SEQ ID NO: 872 - protein, 13 aa, Artificial Sequence
  MHC class II binding epitope
QSVPYGVSQIKAP

SEQ ID NO: 873 - protein, 13 aa, Artificial Sequence
  MHC class II binding epitope
SVPYGVSQIKAPA

SEQ ID NO: 874 - protein, 13 aa, Artificial Sequence
  MHC class II binding epitope
VPYGVSQIKAPAL

SEQ ID NO: 875 - protein, 13 aa, Artificial Sequence
  MHC class II binding epitope
YGVSQIKAPALHS

SEQ ID NO: 876 - protein, 13 aa, Artificial Sequence
  MHC class II binding epitope
VSQIKAPALHSQG

SEQ ID NO: 877 - protein, 13 aa, Artificial Sequence
  MHC class II binding epitope
SQIKAPALHSQGY

SEQ ID NO: 878 - protein, 13 aa, Artificial Sequence
  MHC class II binding epitope
PALHSQGYTGSNV

SEQ ID NO: 879 - protein, 13 aa, Artificial Sequence
  MHC class II binding epitope
QGYTGSNVKVAVI

SEQ ID NO: 880 - protein, 13 aa, Artificial Sequence
  MHC class II binding epitope
SNVKVAVIDSGID

SEQ ID NO: 881 - protein, 13 aa, Artificial Sequence
  MHC class II binding epitope
VKVAVIDSGIDSS

SEQ ID NO: 882 - protein, 13 aa, Artificial Sequence
  MHC class II binding epitope
KVAVIDSGIDSSH

SEQ ID NO: 883 - protein, 13 aa, Artificial Sequence
  MHC class II binding epitope
VAVIDSGIDSSHP

SEQ ID NO: 884 - protein, 13 aa, Artificial Sequence
  MHC class II binding epitope
AVIDSGIDSSHPD

SEQ ID NO: 885 - protein, 13 aa, Artificial Sequence
  MHC class II binding epitope
VIDSGIDSSHPDL

SEQ ID NO: 886 - protein, 13 aa, Artificial Sequence
  MHC class II binding epitope
SGIDSSHPDLKVA

SEQ ID NO: 887 - protein, 13 aa, Artificial Sequence
  MHC class II binding epitope
DSSHPDLKVAGGA

SEQ ID NO: 888 - protein, 13 aa, Artificial Sequence
  MHC class II binding epitope
SHPDLKVAGGASM

SEQ ID NO: 889 - protein, 13 aa, Artificial Sequence
  MHC class II binding epitope
HPDLKVAGGASMV

SEQ ID NO: 890 - protein, 13 aa, Artificial Sequence
  MHC class II binding epitope
PDLKVAGGASMVP

SEQ ID NO: 891 - protein, 13 aa, Artificial Sequence
  MHC class II binding epitope
DLKVAGGASMVPS

SEQ ID NO: 892 - protein, 13 aa, Artificial Sequence
  MHC class II binding epitope
LKVAGGASMVPSE

SEQ ID NO: 893 - protein, 13 aa, Artificial Sequence
  MHC class II binding epitope
GGASMVPSETNPF

SEQ ID NO: 894 - protein, 13 aa, Artificial Sequence
  MHC class II binding epitope
ASMVPSETNPFQD

SEQ ID NO: 895 - protein, 13 aa, Artificial Sequence
  MHC class II binding epitope
SMVPSETNPFQDN

SEQ ID NO: 896 - protein, 13 aa, Artificial Sequence
  MHC class II binding epitope
NPFQDNNSHGTHV

SEQ ID NO: 897 - protein, 13 aa, Artificial Sequence
  MHC class II binding epitope
FQDNNSHGTHVAG

SEQ ID NO: 898 - protein, 13 aa, Artificial Sequence
  MHC class II binding epitope
SHGTHVAGTVAAL

SEQ ID NO: 899 - protein, 13 aa, Artificial Sequence
  MHC class II binding epitope
HGTHVAGTVAALN

SEQ ID NO: 900 - protein, 13 aa, Artificial Sequence
  MHC class II binding epitope
THVAGTVAALNNS

SEQ ID NO: 901 - protein, 13 aa, Artificial Sequence
  MHC class II binding epitope
AGTVAALNNSIGV

SEQ ID NO: 902 - protein, 13 aa, Artificial Sequence
  MHC class II binding epitope
GTVAALNNSIGVL

SEQ ID NO: 903 - protein, 13 aa, Artificial Sequence
  MHC class II binding epitope
AALNNSIGVLGVA

SEQ ID NO: 904 - protein, 13 aa, Artificial Sequence
  MHC class II binding epitope
ALNNSIGVLGVAP

SEQ ID NO: 905 - protein, 13 aa, Artificial Sequence
  MHC class II binding epitope
NNSIGVLGVAPSA

SEQ ID NO: 906 - protein, 13 aa, Artificial Sequence
  MHC class II binding epitope
NSIGVLGVAPSAS

SEQ ID NO: 907 - protein, 13 aa, Artificial Sequence
  MHC class II binding epitope
SIGVLGVAPSASL

SEQ ID NO: 908 - protein, 13 aa, Artificial Sequence
  MHC class II binding epitope
IGVLGVAPSASLY

SEQ ID NO: 909 - protein, 13 aa, Artificial Sequence
  MHC class II binding epitope
GVLGVAPSASLYA

SEQ ID NO: 910 - protein, 13 aa, Artificial Sequence
  MHC class II binding epitope
LGVAPSASLYAVK

SEQ ID NO: 911 - protein, 13 aa, Artificial Sequence
  MHC class II binding epitope
APSASLYAVKVLG

SEQ ID NO: 912 - protein, 13 aa, Artificial Sequence
  MHC class II binding epitope
ASLYAVKVLGADG

SEQ ID NO: 913 - protein, 13 aa, Artificial Sequence
  MHC class II binding epitope
SLYAVKVLGADGS

SEQ ID NO: 914 - protein, 13 aa, Artificial Sequence
  MHC class II binding epitope
YAVKVLGADGSGQ

SEQ ID NO: 915 - protein, 13 aa, Artificial Sequence
  MHC class II binding epitope
VKVLGADGSGQYS

SEQ ID NO: 916 - protein, 13 aa, Artificial Sequence
  MHC class II binding epitope
KVLGADGSGQYSW

SEQ ID NO: 917 - protein, 13 aa, Artificial Sequence
  MHC class II binding epitope
ADGSGQYSWIING

SEQ ID NO: 918 - protein, 13 aa, Artificial Sequence
  MHC class II binding epitope
GQYSWIINGIEWA

SEQ ID NO: 919 - protein, 13 aa, Artificial Sequence
  MHC class II binding epitope
YSWIINGIEWAIA

SEQ ID NO: 920 - protein, 13 aa, Artificial Sequence
  MHC class II binding epitope
SWIINGIEWAIAN

SEQ ID NO: 921 - protein, 13 aa, Artificial Sequence
  MHC class II binding epitope
WIINGIEWAIANN

SEQ ID NO: 922 - protein, 13 aa, Artificial Sequence
  MHC class II binding epitope
NGIEWAIANNMDV

SEQ ID NO: 923 - protein, 13 aa, Artificial Sequence
  MHC class II binding epitope
IEWAIANNMDVIN

SEQ ID NO: 924 - protein, 13 aa, Artificial Sequence
  MHC class II binding epitope
WAIANNMDVINMS

SEQ ID NO: 925 - protein, 13 aa, Artificial Sequence
  MHC class II binding epitope
ANNMDVINMSLGG

SEQ ID NO: 926 - protein, 13 aa, Artificial Sequence
  MHC class II binding epitope
NNMDVINMSLGGP

SEQ ID NO: 927 - protein, 13 aa, Artificial Sequence
  MHC class II binding epitope
MDVINMSLGGPSG

SEQ ID NO: 928 - protein, 13 aa, Artificial Sequence
  MHC class II binding epitope
DVINMSLGGPSGS

SEQ ID NO: 929 - protein, 13 aa, Artificial Sequence
  MHC class II binding epitope
INMSLGGPSGSAA

SEQ ID NO: 930 - protein, 13 aa, Artificial Sequence
  MHC class II binding epitope
MSLGGPSGSAALK

SEQ ID NO: 931 - protein, 13 aa, Artificial Sequence
  MHC class II binding epitope
AALKAAVDKAVAS

SEQ ID NO: 932 - protein, 13 aa, Artificial Sequence
  MHC class II binding epitope
ALKAAVDKAVASG

SEQ ID NO: 933 - protein, 13 aa, Artificial Sequence
  MHC class II binding epitope
AAVDKAVASGVVV

SEQ ID NO: 934 - protein, 13 aa, Artificial Sequence
  MHC class II binding epitope
AVDKAVASGVVVV

SEQ ID NO: 935 - protein, 13 aa, Artificial Sequence
  MHC class II binding epitope
KAVASGVVVVAAA

SEQ ID NO: 936 - protein, 13 aa, Artificial Sequence
  MHC class II binding epitope
SGVVVVAAAGNEG

SEQ ID NO: 937 - protein, 13 aa, Artificial Sequence
  MHC class II binding epitope
GVVVVAAAGNEGT

SEQ ID NO: 938 - protein, 13 aa, Artificial Sequence
  MHC class II binding epitope
VVVVAAAGNEGTS

SEQ ID NO: 939 - protein, 13 aa, Artificial Sequence
  MHC class II binding epitope
VVVAAAGNEGTSG

SEQ ID NO: 940 - protein, 13 aa, Artificial Sequence
  MHC class II binding epitope
AAAGNEGTSGSSS

SEQ ID NO: 941 - protein, 13 aa, Artificial Sequence
  MHC class II binding epitope
SSTVGYPGKYPSV

SEQ ID NO: 942 - protein, 13 aa, Artificial Sequence
  MHC class II binding epitope
STVGYPGKYPSVI

SEQ ID NO: 943 - protein, 13 aa, Artificial Sequence
  MHC class II binding epitope
VGYPGKYPSVIAV

SEQ ID NO: 944 - protein, 13 aa, Artificial Sequence
  MHC class II binding epitope
GKYPSVIAVGAVD

SEQ ID NO: 945 - protein, 13 aa, Artificial Sequence
  MHC class II binding epitope
PSVIAVGAVDSSN

SEQ ID NO: 946 - protein, 13 aa, Artificial Sequence
  MHC class II binding epitope
SVIAVGAVDSSNQ

SEQ ID NO: 947 - protein, 13 aa, Artificial Sequence
  MHC class II binding epitope
IAVGAVDSSNQRA

SEQ ID NO: 948 - protein, 13 aa, Artificial Sequence
  MHC class II binding epitope
GAVDSSNQRASFS

SEQ ID NO: 949 - protein, 13 aa, Artificial Sequence
  MHC class II binding epitope
VDSSNQRASFSSV

SEQ ID NO: 950 - protein, 13 aa, Artificial Sequence
  MHC class II binding epitope
ASFSSVGPELDVM

SEQ ID NO: 951 - protein, 13 aa, Artificial Sequence
  MHC class II binding epitope
SSVGPELDVMAPG

SEQ ID NO: 952 - protein, 13 aa, Artificial Sequence
  MHC class II binding epitope
GPELDVMAPGVSI

SEQ ID NO: 953 - protein, 13 aa, Artificial Sequence
  MHC class II binding epitope
PELDVMAPGVSIQ

SEQ ID NO: 954 - protein, 13 aa, Artificial Sequence
  MHC class II binding epitope
ELDVMAPGVSIQS

SEQ ID NO: 955 - protein, 13 aa, Artificial Sequence
  MHC class II binding epitope
LDVMAPGVSIQST

SEQ ID NO: 956 - protein, 13 aa, Artificial Sequence
  MHC class II binding epitope
DVMAPGVSIQSTL

SEQ ID NO: 957 - protein, 13 aa, Artificial Sequence
  MHC class II binding epitope
APGVSIQSTLPGN

SEQ ID NO: 958 - protein, 13 aa, Artificial Sequence
  MHC class II binding epitope
PGVSIQSTLPGNK

SEQ ID NO: 959 - protein, 13 aa, Artificial Sequence
  MHC class II binding epitope
VSIQSTLPGNKYG

SEQ ID NO: 960 - protein, 13 aa, Artificial Sequence
  MHC class II binding epitope
STLPGNKYGAYNG

SEQ ID NO: 961 - protein, 13 aa, Artificial Sequence
  MHC class II binding epitope
GNKYGAYNGTSMA

SEQ ID NO: 962 - protein, 13 aa, Artificial Sequence
  MHC class II binding epitope
NKYGAYNGTSMAS

SEQ ID NO: 963 - protein, 11 aa, Artificial Sequence
  MHC class II binding epitope
GAYNGTSMDHV

SEQ ID NO: 964 - protein, 11 aa, Artificial Sequence
  MHC class II binding epitope
YNGTSMDHVAG

SEQ ID NO: 965 - protein, 11 aa, Artificial Sequence
  MHC class II binding epitope
TSMDHVAGAAA

SEQ ID NO: 966 - protein, 11 aa, Artificial Sequence
  MHC class II binding epitope
MDHVAGAAALI

SEQ ID NO: 967 - protein, 13 aa, Artificial Sequence
  MHC class II binding epitope
PHVAGAAALILSK

SEQ ID NO: 968 - protein, 13 aa, Artificial Sequence
  MHC class II binding epitope
AAALILSKHPNWT

SEQ ID NO: 969 - protein, 13 aa, Artificial Sequence
  MHC class II binding epitope
AALILSKHPNWTN

SEQ ID NO: 970 - protein, 13 aa, Artificial Sequence
  MHC class II binding epitope
ALILSKHPNWTNT

SEQ ID NO: 971 - protein, 13 aa, Artificial Sequence
  MHC class II binding epitope
LILSKHPNWTNTQ

SEQ ID NO: 972 - protein, 13 aa, Artificial Sequence
  MHC class II binding epitope
PNWTNTQVRSSLE

SEQ ID NO: 973 - protein, 13 aa, Artificial Sequence
  MHC class II binding epitope
TQVRSSLENTTTK

SEQ ID NO: 974 - protein, 13 aa, Artificial Sequence
  MHC class II binding epitope
QVRSSLENTTTKL

SEQ ID NO: 975 - protein, 13 aa, Artificial Sequence
  MHC class II binding epitope
VRSSLENTTTKLG

SEQ ID NO: 976 - protein, 13 aa, Artificial Sequence
  MHC class II binding epitope
SSLENTTTKLGDS

SEQ ID NO: 977 - protein, 13 aa, Artificial Sequence
  MHC class II binding epitope
TKLGDSFYYGKGL

SEQ ID NO: 978 - protein, 13 aa, Artificial Sequence
  MHC class II binding epitope
LGDSFYYGKGLIN

SEQ ID NO: 979 - protein, 13 aa, Artificial Sequence
  MHC class II binding epitope
DSFYYGKGLINVQ

SEQ ID NO: 980 - protein, 13 aa, Artificial Sequence
  MHC class II binding epitope
SFYYGKGLINVQA

SEQ ID NO: 981 - protein, 13 aa, Artificial Sequence
  MHC class II binding epitope
FYYGKGLINVQAA

SEQ ID NO: 982 - protein, 13 aa, Artificial Sequence
  MHC class II binding epitope
YYGKGLINVQAAA

SEQ ID NO: 983 - protein, 13 aa, Artificial Sequence
  MHC class II binding epitope
QSVPYGISQIKAP

SEQ ID NO: 984 - protein, 13 aa, Artificial Sequence
  MHC class II binding epitope
SVPYGISQIKAPA

SEQ ID NO: 985 - protein, 13 aa, Artificial Sequence
  MHC class II binding epitope
VPYGISQIKAPAL

SEQ ID NO: 986 - protein, 13 aa, Artificial Sequence
  MHC class II binding epitope
YGISQIKAPALHS

SEQ ID NO: 987 - protein, 13 aa, Artificial Sequence
  MHC class II binding epitope
ISQIKAPALHSQG

SEQ ID NO: 988 - protein, 13 aa, Artificial Sequence
  MHC class II binding epitope
SQIKAPALHSQGY

SEQ ID NO: 989 - protein, 13 aa, Artificial Sequence
  MHC class II binding epitope
PALHSQGYTGSNV

SEQ ID NO: 990 - protein, 13 aa, Artificial Sequence
  MHC class II binding epitope
QGYTGSNVKVAVI

SEQ ID NO: 991 - protein, 13 aa, Artificial Sequence
  MHC class II binding epitope
SNVKVAVIDSGID

SEQ ID NO: 992 - protein, 13 aa, Artificial Sequence
  MHC class II binding epitope
VKVAVIDSGIDSS

SEQ ID NO: 993 - protein, 13 aa, Artificial Sequence
  MHC class II binding epitope
KVAVIDSGIDSSH

SEQ ID NO: 994 - protein, 13 aa, Artificial Sequence
  MHC class II binding epitope
VAVIDSGIDSSHP

SEQ ID NO: 995 - protein, 13 aa, Artificial Sequence
  MHC class II binding epitope
AVIDSGIDSSHPD

SEQ ID NO: 996 - protein, 13 aa, Artificial Sequence
  MHC class II binding epitope
VIDSGIDSSHPDL

SEQ ID NO: 997 - protein, 13 aa, Artificial Sequence
  MHC class II binding epitope
SGIDSSHPDLNVR

SEQ ID NO: 998 - protein, 13 aa, Artificial Sequence
  MHC class II binding epitope
DSSHPDLNVRGGA

SEQ ID NO: 999 - protein, 13 aa, Artificial Sequence
  MHC class II binding epitope
HPDLNVRGGASFV

SEQ ID NO: 1000 - protein, 13 aa, Artificial Sequence
  MHC class II binding epitope
PDLNVRGGASFVP

SEQ ID NO: 1001 - protein, 13 aa, Artificial Sequence
  MHC class II binding epitope
DLNVRGGASFVPS

SEQ ID NO: 1002 - protein, 13 aa, Artificial Sequence
  MHC class II binding epitope
LNVRGGASFVPSE

SEQ ID NO: 1003 - protein, 13 aa, Artificial Sequence
  MHC class II binding epitope
GGASFVPSETNPY

SEQ ID NO: 1004 - protein, 13 aa, Artificial Sequence
  MHC class II binding epitope
ASFVPSETNPYQD

SEQ ID NO: 1005 - protein, 13 aa, Artificial Sequence
  MHC class II binding epitope
SFVPSETNPYQDG

SEQ ID NO: 1006 - protein, 13 aa, Artificial Sequence
  MHC class II binding epitope
NPYQDGGSHGTHV

SEQ ID NO: 1007 - protein, 13 aa, Artificial Sequence
  MHC class II binding epitope
SHGTHVAGTIAAL

SEQ ID NO: 1008 - protein, 13 aa, Artificial Sequence
  MHC class II binding epitope
HGTHVAGTIAALN

SEQ ID NO: 1009 - protein, 13 aa, Artificial Sequence
  MHC class II binding epitope
THVAGTIAALNNS

SEQ ID NO: 1010 - protein, 13 aa, Artificial Sequence
  MHC class II binding epitope
AGTIAALNNSIGV

SEQ ID NO: 1011 - protein, 13 aa, Artificial Sequence
  MHC class II binding epitope
GTIAALNNSIGVL

SEQ ID NO: 1012 - protein, 13 aa, Artificial Sequence
  MHC class II binding epitope
AALNNSIGVLGVS

SEQ ID NO: 1013 - protein, 13 aa, Artificial Sequence
  MHC class II binding epitope
ALNNSIGVLGVSP

SEQ ID NO: 1014 - protein, 13 aa, Artificial Sequence
  MHC class II binding epitope
NNSIGVLGVSPSA

SEQ ID NO: 1015 - protein, 13 aa, Artificial Sequence
  MHC class II binding epitope
NSIGVLGVSPSAS

SEQ ID NO: 1016 - protein, 13 aa, Artificial Sequence
  MHC class II binding epitope
IGVLGVSPSASLY

SEQ ID NO: 1017 - protein, 13 aa, Artificial Sequence
  MHC class II binding epitope
GVLGVSPSASLYA

SEQ ID NO: 1018 - protein, 13 aa, Artificial Sequence
  MHC class II binding epitope
LGVSPSASLYAVK

SEQ ID NO: 1019 - protein, 13 aa, Artificial Sequence
  MHC class II binding epitope
SPSASLYAVKVLD

SEQ ID NO: 1020 - protein, 13 aa, Artificial Sequence
  MHC class II binding epitope
ASLYAVKVLDSTG

SEQ ID NO: 1021 - protein, 13 aa, Artificial Sequence
  MHC class II binding epitope
YAVKVLDSTGSGQ

SEQ ID NO: 1022 - protein, 13 aa, Artificial Sequence
  MHC class II binding epitope
VKVLDSTGSGQYS

SEQ ID NO: 1023 - protein, 13 aa, Artificial Sequence
  MHC class II binding epitope
KVLDSTGSGQYSW

SEQ ID NO: 1024 - protein, 13 aa, Artificial Sequence
  MHC class II binding epitope
STGSGQYSWIING

SEQ ID NO: 1025 - protein, 13 aa, Artificial Sequence
  MHC class II binding epitope
GQYSWIINGIEWA

SEQ ID NO: 1026 - protein, 13 aa, Artificial Sequence
  MHC class II binding epitope
YSWIINGIEWAIS

SEQ ID NO: 1027 - protein, 13 aa, Artificial Sequence
  MHC class II binding epitope
SWIINGIEWAISN

SEQ ID NO: 1028 - protein, 13 aa, Artificial Sequence
  MHC class II binding epitope
WIINGIEWAISNN

SEQ ID NO: 1029 - protein, 13 aa, Artificial Sequence
  MHC class II binding epitope
NGIEWAISNNMDV

SEQ ID NO: 1030 - protein, 13 aa, Artificial Sequence
  MHC class II binding epitope
IEWAISNNMDVIN

SEQ ID NO: 1031 - protein, 13 aa, Artificial Sequence
  MHC class II binding epitope
WAISNNMDVINMS

SEQ ID NO: 1032 - protein, 13 aa, Artificial Sequence
  MHC class II binding epitope
SNNMDVINMSLGG

SEQ ID NO: 1033 - protein, 13 aa, Artificial Sequence
  MHC class II binding epitope
NNMDVINMSLGGP

SEQ ID NO: 1034 - protein, 13 aa, Artificial Sequence
  MHC class II binding epitope
MDVINMSLGGPTG

SEQ ID NO: 1035 - protein, 13 aa, Artificial Sequence
  MHC class II binding epitope
DVINMSLGGPTGS

SEQ ID NO: 1036 - protein, 13 aa, Artificial Sequence
  MHC class II binding epitope
INMSLGGPTGSTA

SEQ ID NO: 1037 - protein, 13 aa, Artificial Sequence
  MHC class II binding epitope
MSLGGPTGSTALK

SEQ ID NO: 1038 - protein, 13 aa, Artificial Sequence
  MHC class II binding epitope
TALKTVVDKAVSS

SEQ ID NO: 1039 - protein, 13 aa, Artificial Sequence
  MHC class II binding epitope
ALKTVVDKAVSSG

SEQ ID NO: 1040 - protein, 13 aa, Artificial Sequence
  MHC class II binding epitope
KTVVDKAVSSGIV

SEQ ID NO: 1041 - protein, 13 aa, Artificial Sequence
  MHC class II binding epitope
TVVDKAVSSGIVV

SEQ ID NO: 1042 - protein, 13 aa, Artificial Sequence
  MHC class II binding epitope
VVDKAVSSGIVVA

SEQ ID NO: 1043 - protein, 13 aa, Artificial Sequence
  MHC class II binding epitope
KAVSSGIVVAAAA

SEQ ID NO: 1044 - protein, 13 aa, Artificial Sequence
  MHC class II binding epitope
VSSGIVVAAAAGN

SEQ ID NO: 1045 - protein, 13 aa, Artificial Sequence
  MHC class II binding epitope
SGIVVAAAAGNEG

SEQ ID NO: 1046 - protein, 13 aa, Artificial Sequence
  MHC class II binding epitope
GIVVAAAAGNEGS

SEQ ID NO: 1047 - protein, 13 aa, Artificial Sequence
  MHC class II binding epitope
IVVAAAAGNEGSS

SEQ ID NO: 1048 - protein, 13 aa, Artificial Sequence
  MHC class II binding epitope
VVAAAAGNEGSSG

SEQ ID NO: 1049 - protein, 13 aa, Artificial Sequence
  MHC class II binding epitope
AAAGNEGSSGSTS

SEQ ID NO: 1050 - protein, 13 aa, Artificial Sequence
  MHC class II binding epitope
TSTVGYPAKYPST

SEQ ID NO: 1051 - protein, 13 aa, Artificial Sequence
  MHC class II binding epitope
STVGYPAKYPSTI

SEQ ID NO: 1052 - protein, 13 aa, Artificial Sequence
  MHC class II binding epitope
VGYPAKYPSTIAV

SEQ ID NO: 1053 - protein, 13 aa, Artificial Sequence
  MHC class II binding epitope
AKYPSTIAVGAVN

SEQ ID NO: 1054 - protein, 13 aa, Artificial Sequence
  MHC class II binding epitope
PSTIAVGAVNSSN

SEQ ID NO: 1055 - protein, 13 aa, Artificial Sequence
  MHC class II binding epitope
STIAVGAVNSSNQ

SEQ ID NO: 1056 - protein, 13 aa, Artificial Sequence
  MHC class II binding epitope
TIAVGAVNSSNQR

SEQ ID NO: 1057 - protein, 13 aa, Artificial Sequence
  MHC class II binding epitope
IAVGAVNSSNQRA

SEQ ID NO: 1058 - protein, 13 aa, Artificial Sequence
  MHC class II binding epitope
GAVNSSNQRASFS

SEQ ID NO: 1059 - protein, 13 aa, Artificial Sequence
  MHC class II binding epitope
VNSSNQRASFSSA

SEQ ID NO: 1060 - protein, 13 aa, Artificial Sequence
  MHC class II binding epitope
NQRASFSSAGSEL

SEQ ID NO: 1061 - protein, 13 aa, Artificial Sequence
  MHC class II binding epitope
ASFSSAGSELDVM

SEQ ID NO: 1062 - protein, 13 aa, Artificial Sequence
  MHC class II binding epitope
GSELDVMAPGVSI

SEQ ID NO: 1063 - protein, 13 aa, Artificial Sequence
  MHC class II binding epitope
ELDVMAPGVSIQS

SEQ ID NO: 1064 - protein, 13 aa, Artificial Sequence
  MHC class II binding epitope
SELDVMAPGVSIQ

SEQ ID NO: 1065 - protein, 13 aa, Artificial Sequence
  MHC class II binding epitope
LDVMAPGVSIQST

SEQ ID NO: 1066 - protein, 13 aa, Artificial Sequence
  MHC class II binding epitope
DVMAPGVSIQSTL

SEQ ID NO: 1067 - protein, 13 aa, Artificial Sequence
  MHC class II binding epitope
APGVSIQSTLPGG

SEQ ID NO: 1068 - protein, 13 aa, Artificial Sequence
  MHC class II binding epitope
PGVSIQSTLPGGT

SEQ ID NO: 1069 - protein, 13 aa, Artificial Sequence
  MHC class II binding epitope
VSIQSTLPGGTYG

SEQ ID NO: 1070 - protein, 13 aa, Artificial Sequence
  MHC class II binding epitope
STLPGGTYGAYNG

SEQ ID NO: 1071 - protein, 13 aa, Artificial Sequence
  MHC class II binding epitope
GGTYGAYNGTSMA

SEQ ID NO: 1072 - protein, 13 aa, Artificial Sequence
  MHC class II binding epitope
GTYGAYNGTSMAT

SEQ ID NO: 1073 - protein, 13 aa, Artificial Sequence
  MHC class II binding epitope
GAYNGTSMATPHV

SEQ ID NO: 1074 - protein, 13 aa, Artificial Sequence
  MHC class II binding epitope
YNGTSMATPHVAG

SEQ ID NO: 1075 - protein, 13 aa, Artificial Sequence
  MHC class II binding epitope
TSMATPHVAGAAA

SEQ ID NO: 1076 - protein, 13 aa, Artificial Sequence
  MHC class II binding epitope
MATPHVAGAAALI

SEQ ID NO: 1077 - protein, 13 aa, Artificial Sequence
  MHC class II binding epitope
PHVAGAAALILSK

SEQ ID NO: 1078 - protein, 13 aa, Artificial Sequence
  MHC class II binding epitope
GAAALILSKHPTW

SEQ ID NO: 1079 - protein, 13 aa, Artificial Sequence
  MHC class II binding epitope
AALILSKHPTWTN

SEQ ID NO: 1080 - protein, 13 aa, Artificial Sequence
  MHC class II binding epitope
ALILSKHPTWTNA

SEQ ID NO: 1081 - protein, 13 aa, Artificial Sequence
  MHC class II binding epitope
LILSKHPTWTNAQ

SEQ ID NO: 1082 - protein, 13 aa, Artificial Sequence
  MHC class II binding epitope
PTWTNAQVRDRLE

SEQ ID NO: 1083 - protein, 13 aa, Artificial Sequence
  MHC class II binding epitope
AQVRDRLESTATY

SEQ ID NO: 1084 - protein, 13 aa, Artificial Sequence
  MHC class II binding epitope
QVRDRLESTATYL

SEQ ID NO: 1085 - protein, 13 aa, Artificial Sequence
  MHC class II binding epitope
DRLESTATYLGNS

SEQ ID NO: 1086 - protein, 13 aa, Artificial Sequence
  MHC class II binding epitope
ATYLGNSFYYGKG

SEQ ID NO: 1087 - protein, 13 aa, Artificial Sequence
  MHC class II binding epitope
TYLGNSFYYGKGL

SEQ ID NO: 1088 - protein, 13 aa, Artificial Sequence
  MHC class II binding epitope
LGNSFYYGKGLIN

SEQ ID NO: 1089 - protein, 13 aa, Artificial Sequence
  MHC class II binding epitope
NSFYYGKGLINVQ

SEQ ID NO: 1090 - protein, 13 aa, Artificial Sequence
  MHC class II binding epitope
SFYYGKGLINVQA

SEQ ID NO: 1091 - protein, 13 aa, Artificial Sequence
  MHC class II binding epitope
FYYGKGLINVQAA

SEQ ID NO: 1092 - protein, 13 aa, Artificial Sequence
  MHC class II binding epitope
YYGKGLINVQAAA

SEQ ID NO: 1093 - protein, 13 aa, Artificial Sequence
  MHC class II binding epitope
QTVPYGIPLIKAD

SEQ ID NO: 1094 - protein, 13 aa, Artificial Sequence
  MHC class II binding epitope
VPYGIPLIKADKV

SEQ ID NO: 1095 - protein, 13 aa, Artificial Sequence
  MHC class II binding epitope
YGIPLIKADKVQA

SEQ ID NO: 1096 - protein, 13 aa, Artificial Sequence
  MHC class II binding epitope
IPLIKADKVQAQG

SEQ ID NO: 1097 - protein, 13 aa, Artificial Sequence
  MHC class II binding epitope
PLIKADKVQAQGF

SEQ ID NO: 1098 - protein, 13 aa, Artificial Sequence
  MHC class II binding epitope
IKADKVQAQGFKG

SEQ ID NO: 1099 - protein, 13 aa, Artificial Sequence
  MHC class II binding epitope
DKVQAQGFKGANV

SEQ ID NO: 1100 - protein, 13 aa, Artificial Sequence
  MHC class II binding epitope
QGFKGANVKVAVL

SEQ ID NO: 1101 - protein, 13 aa, Artificial Sequence
  MHC class II binding epitope
ANVKVAVLDTGIQ

SEQ ID NO: 1102 - protein, 13 aa, Artificial Sequence
  MHC class II binding epitope
VKVAVLDTGIQAS

SEQ ID NO: 1103 - protein, 13 aa, Artificial Sequence
  MHC class II binding epitope
KVAVLDTGIQASH

SEQ ID NO: 1104 - protein, 13 aa, Artificial Sequence
  MHC class II binding epitope
VAVLDTGIQASHP

SEQ ID NO: 1105 - protein, 13 aa, Artificial Sequence
  MHC class II binding epitope
AVLDTGIQASHPD

SEQ ID NO: 1106 - protein, 13 aa, Artificial Sequence
  MHC class II binding epitope
VLDTGIQASHPDL

SEQ ID NO: 1107 - protein, 13 aa, Artificial Sequence
  MHC class II binding epitope
DTGIQASHPDLNV

SEQ ID NO: 1108 - protein, 13 aa, Artificial Sequence
  MHC class II binding epitope
TGIQASHPDLNVV

SEQ ID NO: 1109 - protein, 13 aa, Artificial Sequence
  MHC class II binding epitope
QASHPDLNVVGGA

SEQ ID NO: 1110 - protein, 13 aa, Artificial Sequence
  MHC class II binding epitope
HPDLNVVGGASFV

SEQ ID NO: 1111 - protein, 13 aa, Artificial Sequence
  MHC class II binding epitope
PDLNVVGGASFVA

SEQ ID NO: 1112 - protein, 13 aa, Artificial Sequence
  MHC class II binding epitope
DLNVVGGASFVAG

SEQ ID NO: 1113 - protein, 13 aa, Artificial Sequence
  MHC class II binding epitope
LNVVGGASFVAGE

SEQ ID NO: 1114 - protein, 13 aa, Artificial Sequence
  MHC class II binding epitope
NVVGGASFVAGEA

SEQ ID NO: 1115 - protein, 13 aa, Artificial Sequence
  MHC class II binding epitope
ASFVAGEAYNTDG

SEQ ID NO: 1116 - protein, 13 aa, Artificial Sequence
  MHC class II binding epitope
SFVAGEAYNTDGN

SEQ ID NO: 1117 - protein, 13 aa, Artificial Sequence
  MHC class II binding epitope
EAYNTDGNGHGTH

SEQ ID NO: 1118 - protein, 13 aa, Artificial Sequence
  MHC class II binding epitope
GHGTHVAGTVAAL

SEQ ID NO: 1119 - protein, 13 aa, Artificial Sequence
  MHC class II binding epitope
HGTHVAGTVAALD

SEQ ID NO: 1120 - protein, 13 aa, Artificial Sequence
  MHC class II binding epitope
THVAGTVAALDNT

SEQ ID NO: 1121 - protein, 13 aa, Artificial Sequence
  MHC class II binding epitope
GTVAALDNTTGVL

SEQ ID NO: 1122 - protein, 13 aa, Artificial Sequence
  MHC class II binding epitope
TVAALDNTTGVLG

SEQ ID NO: 1123 - protein, 13 aa, Artificial Sequence
  MHC class II binding epitope
AALDNTTGVLGVA

SEQ ID NO: 1124 - protein, 13 aa, Artificial Sequence
  MHC class II binding epitope
DNTTGVLGVAPSV

SEQ ID NO: 1125 - protein, 13 aa, Artificial Sequence
  MHC class II binding epitope
TTGVLGVAPSVSL

SEQ ID NO: 1126 - protein, 13 aa, Artificial Sequence
  MHC class II binding epitope
TGVLGVAPSVSLY

SEQ ID NO: 1127 - protein, 13 aa, Artificial Sequence
  MHC class II binding epitope
GVLGVAPSVSLYA

SEQ ID NO: 1128 - protein, 13 aa, Artificial Sequence
  MHC class II binding epitope
LGVAPSVSLYAVK

SEQ ID NO: 1129 - protein, 13 aa, Artificial Sequence
  MHC class II binding epitope
APSVSLYAVKVLN

SEQ ID NO: 1130 - protein, 13 aa, Artificial Sequence
  MHC class II binding epitope
PSVSLYAVKVLNS

SEQ ID NO: 1131 - protein, 13 aa, Artificial Sequence
  MHC class II binding epitope
VSLYAVKVLNSSG

SEQ ID NO: 1132 - protein, 13 aa, Artificial Sequence
  MHC class II binding epitope
SLYAVKVLNSSGS

SEQ ID NO: 1133 - protein, 13 aa, Artificial Sequence
  MHC class II binding epitope
YAVKVLNSSGSGS

SEQ ID NO: 1134 - protein, 13 aa, Artificial Sequence
  MHC class II binding epitope
VKVLNSSGSGSYS

SEQ ID NO: 1135 - protein, 13 aa, Artificial Sequence
  MHC class II binding epitope
KVLNSSGSGSYSG

SEQ ID NO: 1136 - protein, 13 aa, Artificial Sequence
  MHC class II binding epitope
GSYSGIVSGIEWA

SEQ ID NO: 1137 - protein, 13 aa, Artificial Sequence
  MHC class II binding epitope
TNGMDVINMSLGG

SEQ ID NO: 1138 - protein, 13 aa, Artificial Sequence
  MHC class II binding epitope
NGMDVINMSLGGA

SEQ ID NO: 1139 - protein, 13 aa, Artificial Sequence
  MHC class II binding epitope
MDVINMSLGGASG

SEQ ID NO: 1140 - protein, 13 aa, Artificial Sequence
  MHC class II binding epitope
DVINMSLGGASGS

SEQ ID NO: 1141 - protein, 13 aa, Artificial Sequence
  MHC class II binding epitope
INMSLGGASGSTA

SEQ ID NO: 1142 - protein, 13 aa, Artificial Sequence
  MHC class II binding epitope
MSLGGASGSTAMK

SEQ ID NO: 1143 - protein, 13 aa, Artificial Sequence
  MHC class II binding epitope
TAMKQAVDNAYAR

SEQ ID NO: 1144 - protein, 13 aa, Artificial Sequence
  MHC class II binding epitope
AMKQAVDNAYARG

SEQ ID NO: 1145 - protein, 13 aa, Artificial Sequence
  MHC class II binding epitope
QAVDNAYARGVVV

SEQ ID NO: 1146 - protein, 13 aa, Artificial Sequence
  MHC class II binding epitope
NAYARGVVVVAAA

SEQ ID NO: 1147 - protein, 13 aa, Artificial Sequence
  MHC class II binding epitope
RGVVVVAAAGNSG

SEQ ID NO: 1148 - protein, 13 aa, Artificial Sequence
  MHC class II binding epitope
GVVVVAAAGNSGN

SEQ ID NO: 1149 - protein, 13 aa, Artificial Sequence
  MHC class II binding epitope
VVVVAAAGNSGNS

SEQ ID NO: 1150 - protein, 13 aa, Artificial Sequence
  MHC class II binding epitope
VVVAAAGNSGNSG

SEQ ID NO: 1151 - protein, 13 aa, Artificial Sequence
  MHC class II binding epitope
NTIGYPAKYDSVI

SEQ ID NO: 1152 - protein, 13 aa, Artificial Sequence
  MHC class II binding epitope
IGYPAKYDSVIAV

SEQ ID NO: 1153 - protein, 13 aa, Artificial Sequence
  MHC class II binding epitope
AKYDSVIAVGAVD

SEQ ID NO: 1154 - protein, 13 aa, Artificial Sequence
  MHC class II binding epitope
DSVIAVGAVDSNS

SEQ ID NO: 1155 - protein, 13 aa, Artificial Sequence
  MHC class II binding epitope
SVIAVGAVDSNSN

SEQ ID NO: 1156 - protein, 13 aa, Artificial Sequence
  MHC class II binding epitope
IAVGAVDSNSNRA

SEQ ID NO: 1157 - protein, 13 aa, Artificial Sequence
  MHC class II binding epitope
AVGAVDSNSNRAS

SEQ ID NO: 1158 - protein, 13 aa, Artificial Sequence
  MHC class II binding epitope
GAVDSNSNRASFS

SEQ ID NO: 1159 - protein, 13 aa, Artificial Sequence
  MHC class II binding epitope
AVDSNSNRASFSS

SEQ ID NO: 1160 - protein, 13 aa, Artificial Sequence
  MHC class II binding epitope
SNRASFSSVGAEL

SEQ ID NO: 1161 - protein, 13 aa, Artificial Sequence
  MHC class II binding epitope
ASFSSVGAELEVM

SEQ ID NO: 1162 - protein, 13 aa, Artificial Sequence
  MHC class II binding epitope
SSVGAELEVMAPG

SEQ ID NO: 1163 - protein, 13 aa, Artificial Sequence
  MHC class II binding epitope
GAELEVMAPGAGV

SEQ ID NO: 1164 - protein, 13 aa, Artificial Sequence
  MHC class II binding epitope
AELEVMAPGAGVY

SEQ ID NO: 1165 - protein, 13 aa, Artificial Sequence
  MHC class II binding epitope
ELEVMAPGAGVYS

SEQ ID NO: 1166 - protein, 13 aa, Artificial Sequence
  MHC class II binding epitope
LEVMAPGAGVYST

SEQ ID NO: 1167 - protein, 13 aa, Artificial Sequence
  MHC class II binding epitope
EVMAPGAGVYSTY

SEQ ID NO: 1168 - protein, 13 aa, Artificial Sequence
  MHC class II binding epitope
APGAGVYSTYPTN

SEQ ID NO: 1169 - protein, 13 aa, Artificial Sequence
  MHC class II binding epitope
AGVYSTYPTNTYA

SEQ ID NO: 1170 - protein, 13 aa, Artificial Sequence
  MHC class II binding epitope
GVYSTYPTNTYAT

SEQ ID NO: 1171 - protein, 13 aa, Artificial Sequence
  MHC class II binding epitope
STYPTNTYATLNG

SEQ ID NO: 1172 - protein, 13 aa, Artificial Sequence
  MHC class II binding epitope
NTYATLNGTSMAS

SEQ ID NO: 1173 - protein, 13 aa, Artificial Sequence
  MHC class II binding epitope
ATLNGTSMASPHV

SEQ ID NO: 1174 - protein, 13 aa, Artificial Sequence
  MHC class II binding epitope
LNGTSMASPHVAG

SEQ ID NO: 1175 - protein, 13 aa, Artificial Sequence
  MHC class II binding epitope
TSMASPHVAGAAA

SEQ ID NO: 1176 - protein, 13 aa, Artificial Sequence
  MHC class II binding epitope
MASPHVAGAAALI

SEQ ID NO: 1177 - protein, 13 aa, Artificial Sequence
  MHC class II binding epitope
PHVAGAAALILSK

SEQ ID NO: 1178 - protein, 13 aa, Artificial Sequence
  MHC class II binding epitope
GAAALILSKHPNL

SEQ ID NO: 1179 - protein, 13 aa, Artificial Sequence
  MHC class II binding epitope
AALILSKHPNLSA

SEQ ID NO: 1180 - protein, 13 aa, Artificial Sequence
  MHC class II binding epitope
ALILSKHPNLSAS

SEQ ID NO: 1181 - protein, 13 aa, Artificial Sequence
  MHC class II binding epitope
LILSKHPNLSASQ

SEQ ID NO: 1182 - protein, 13 aa, Artificial Sequence
  MHC class II binding epitope
SKHPNLSASQVRN

SEQ ID NO: 1183 - protein, 13 aa, Artificial Sequence
  MHC class II binding epitope
HPNLSASQVRNRL

SEQ ID NO: 1184 - protein, 13 aa, Artificial Sequence
  MHC class II binding epitope
PNLSASQVRNRLS

SEQ ID NO: 1185 - protein, 13 aa, Artificial Sequence
  MHC class II binding epitope
LSASQVRNRLSST

SEQ ID NO: 1186 - protein, 13 aa, Artificial Sequence
  MHC class II binding epitope
SQVRNRLSSTATY

SEQ ID NO: 1187 - protein, 13 aa, Artificial Sequence
  MHC class II binding epitope
QVRNRLSSTATYL

SEQ ID NO: 1188 - protein, 13 aa, Artificial Sequence
  MHC class II binding epitope
NRLSSTATYLGSS

SEQ ID NO: 1189 - protein, 13 aa, Artificial Sequence
  MHC class II binding epitope
ATYLGSSFYYGKG

SEQ ID NO: 1190 - protein, 13 aa, Artificial Sequence
  MHC class II binding epitope
TYLGSSFYYGKGL

SEQ ID NO: 1191 - protein, 13 aa, Artificial Sequence
  MHC class II binding epitope
LGSSFYYGKGLIN

SEQ ID NO: 1192 - protein, 13 aa, Artificial Sequence
  MHC class II binding epitope
SSFYYGKGLINVE

SEQ ID NO: 1193 - protein, 13 aa, Artificial Sequence
  MHC class II binding epitope
SFYYGKGLINVEA

SEQ ID NO: 1194 - protein, 13 aa, Artificial Sequence
  MHC class II binding epitope
FYYGKGLINVEAA

SEQ ID NO: 1195 - protein, 13 aa, Artificial Sequence
  MHC class II binding epitope
YYGKGLINVEAAA

SEQ ID NO: 1196 - protein, 13 aa, Artificial Sequence
  MHC class II binding epitope
PGPSIQKTYDLTR

SEQ ID NO: 1197 - protein, 13 aa, Artificial Sequence
  MHC class II binding epitope
PSIQKTYDLTRYL

SEQ ID NO: 1198 - protein, 13 aa, Artificial Sequence
  MHC class II binding epitope
IQKTYDLTRYLEH

SEQ ID NO: 1199 - protein, 13 aa, Artificial Sequence
  MHC class II binding epitope
KTYDLTRYLEHQL

SEQ ID NO: 1200 - protein, 13 aa, Artificial Sequence
  MHC class II binding epitope
YDLTRYLEHQLRS

SEQ ID NO: 1201 - protein, 13 aa, Artificial Sequence
  MHC class II binding epitope
LTRYLEHQLRSLA

SEQ ID NO: 1202 - protein, 13 aa, Artificial Sequence
  MHC class II binding epitope
TRYLEHQLRSLAG

SEQ ID NO: 1203 - protein, 13 aa, Artificial Sequence
  MHC class II binding epitope
RYLEHQLRSLAGT

SEQ ID NO: 1204 - protein, 13 aa, Artificial Sequence
  MHC class II binding epitope
HQLRSLAGTYLNY

SEQ ID NO: 1205 - protein, 13 aa, Artificial Sequence
  MHC class II binding epitope
QLRSLAGTYLNYL

SEQ ID NO: 1206 - protein, 13 aa, Artificial Sequence
  MHC class II binding epitope
RSLAGTYLNYLGP

SEQ ID NO: 1207 - protein, 13 aa, Artificial Sequence
  MHC class II binding epitope
GTYLNYLGPPFNE

SEQ ID NO: 1208 - protein, 13 aa, Artificial Sequence
  MHC class II binding epitope
TYLNYLGPPFNEP

SEQ ID NO: 1209 - protein, 13 aa, Artificial Sequence
  MHC class II binding epitope
NYLGPPFNEPDFN

SEQ ID NO: 1210 - protein, 13 aa, Artificial Sequence
  MHC class II binding epitope
PPFNEPDFNPPRL

SEQ ID NO: 1211 - protein, 13 aa, Artificial Sequence
  MHC class II binding epitope
PFNEPDFNPPRLG

SEQ ID NO: 1212 - protein, 13 aa, Artificial Sequence
  MHC class II binding epitope
PDFNPPRLGAETL

SEQ ID NO: 1213 - protein, 13 aa, Artificial Sequence
  MHC class II binding epitope
FNPPRLGAETLPR

SEQ ID NO: 1214 - protein, 13 aa, Artificial Sequence
  MHC class II binding epitope
PRLGAETLPRATV

SEQ ID NO: 1215 - protein, 13 aa, Artificial Sequence
  MHC class II binding epitope
LGAETLPRATVDL

SEQ ID NO: 1216 - protein, 13 aa, Artificial Sequence
  MHC class II binding epitope
ETLPRATVDLEVW

SEQ ID NO: 1217 - protein, 13 aa, Artificial Sequence
  MHC class II binding epitope
PRATVDLEVWRSL

SEQ ID NO: 1218 - protein, 13 aa, Artificial Sequence
  MHC class II binding epitope
ATVDLEVWRSLND

SEQ ID NO: 1219 - protein, 13 aa, Artificial Sequence
  MHC class II binding epitope
TVDLEVWRSLNDK

SEQ ID NO: 1220 - protein, 13 aa, Artificial Sequence
  MHC class II binding epitope
VDLEVWRSLNDKL

SEQ ID NO: 1221 - protein, 13 aa, Artificial Sequence
  MHC class II binding epitope
LEVWRSLNDKLRL

SEQ ID NO: 1222 - protein, 13 aa, Artificial Sequence
  MHC class II binding epitope
EVWRSLNDKLRLT

SEQ ID NO: 1223 - protein, 13 aa, Artificial Sequence
  MHC class II binding epitope
VWRSLNDKLRLTQ

SEQ ID NO: 1224 - protein, 13 aa, Artificial Sequence
  MHC class II binding epitope
RSLNDKLRLTQNY

SEQ ID NO: 1225 - protein, 13 aa, Artificial Sequence
  MHC class II binding epitope
DKLRLTQNYEAYS

SEQ ID NO: 1226 - protein, 13 aa, Artificial Sequence
  MHC class II binding epitope
KLRLTQNYEAYSH

SEQ ID NO: 1227 - protein, 13 aa, Artificial Sequence
  MHC class II binding epitope
LRLTQNYEAYSHL

SEQ ID NO: 1228 - protein, 13 aa, Artificial Sequence
  MHC class II binding epitope
TQNYEAYSHLLCY

SEQ ID NO: 1229 - protein, 13 aa, Artificial Sequence
  MHC class II binding epitope
QNYEAYSHLLCYL

SEQ ID NO: 1230 - protein, 13 aa, Artificial Sequence
  MHC class II binding epitope
EAYSHLLCYLRGL

SEQ ID NO: 1231 - protein, 13 aa, Artificial Sequence
  MHC class II binding epitope
SHLLCYLRGLNRQ

SEQ ID NO: 1232 - protein, 13 aa, Artificial Sequence
  MHC class II binding epitope
HLLCYLRGLNRQA

SEQ ID NO: 1233 - protein, 13 aa, Artificial Sequence
  MHC class II binding epitope
LCYLRGLNRQAAT

SEQ ID NO: 1234 - protein, 13 aa, Artificial Sequence
  MHC class II binding epitope
CYLRGLNRQAATA

SEQ ID NO: 1235 - protein, 13 aa, Artificial Sequence
  MHC class II binding epitope
RGLNRQAATAELR

SEQ ID NO: 1236 - protein, 13 aa, Artificial Sequence
  MHC class II binding epitope
GLNRQAATAELRR

SEQ ID NO: 1237 - protein, 13 aa, Artificial Sequence
  MHC class II binding epitope
QAATAELRRSLAH

SEQ ID NO: 1238 - protein, 13 aa, Artificial Sequence
  MHC class II binding epitope
AATAELRRSLAHF

SEQ ID NO: 1239 - protein, 13 aa, Artificial Sequence
  MHC class II binding epitope
AELRRSLAHFCTS

SEQ ID NO: 1240 - protein, 13 aa, Artificial Sequence
  MHC class II binding epitope
ELRRSLAHFCTSL

SEQ ID NO: 1241 - protein, 13 aa, Artificial Sequence
  MHC class II binding epitope
RSLAHFCTSLQGL

SEQ ID NO: 1242 - protein, 13 aa, Artificial Sequence
  MHC class II binding epitope
AHFCTSLQGLLGS

SEQ ID NO: 1243 - protein, 13 aa, Artificial Sequence
  MHC class II binding epitope
TSLQGLLGSIAGV

SEQ ID NO: 1244 - protein, 13 aa, Artificial Sequence
  MHC class II binding epitope
SLQGLLGSIAGVM

SEQ ID NO: 1245 - protein, 13 aa, Artificial Sequence
  MHC class II binding epitope
QGLLGSIAGVMAA

SEQ ID NO: 1246 - protein, 13 aa, Artificial Sequence
  MHC class II binding epitope
GLLGSIAGVMAAL

SEQ ID NO: 1247 - protein, 13 aa, Artificial Sequence
  MHC class II binding epitope
LLGSIAGVMAALG

SEQ ID NO: 1248 - protein, 13 aa, Artificial Sequence
  MHC class II binding epitope
GSIAGVMAALGYP

SEQ ID NO: 1249 - protein, 13 aa, Artificial Sequence
  MHC class II binding epitope
SIAGVMAALGYPL

SEQ ID NO: 1250 - protein, 13 aa, Artificial Sequence
  MHC class II binding epitope
AGVMAALGYPLPQ

SEQ ID NO: 1251 - protein, 13 aa, Artificial Sequence
  MHC class II binding epitope
GVMAALGYPLPQP

SEQ ID NO: 1252 - protein, 13 aa, Artificial Sequence
  MHC class II binding epitope
AALGYPLPQPLPG

SEQ ID NO: 1253 - protein, 13 aa, Artificial Sequence
  MHC class II binding epitope
LGYPLPQPLPGTE

SEQ ID NO: 1254 - protein, 13 aa, Artificial Sequence
  MHC class II binding epitope
YPLPQPLPGTEPT

SEQ ID NO: 1255 - protein, 13 aa, Artificial Sequence
  MHC class II binding epitope
QPLPGTEPTWTPG

SEQ ID NO: 1256 - protein, 13 aa, Artificial Sequence
  MHC class II binding epitope
PTWTPGPAHSDFL

SEQ ID NO: 1257 - protein, 13 aa, Artificial Sequence
  MHC class II binding epitope
WTPGPAHSDFLQK

SEQ ID NO: 1258 - protein, 13 aa, Artificial Sequence
  MHC class II binding epitope
HSDFLQKMDDFWL

SEQ ID NO: 1259 - protein, 13 aa, Artificial Sequence
  MHC class II binding epitope
SDFLQKMDDFWLL

SEQ ID NO: 1260 - protein, 13 aa, Artificial Sequence
  MHC class II binding epitope
DFLQKMDDFWLLK

SEQ ID NO: 1261 - protein, 13 aa, Artificial Sequence
  MHC class II binding epitope
FLQKMDDFWLLKE

SEQ ID NO: 1262 - protein, 13 aa, Artificial Sequence
  MHC class II binding epitope
QKMDDFWLLKELQ

SEQ ID NO: 1263 - protein, 13 aa, Artificial Sequence
  MHC class II binding epitope
DDFWLLKELQTWL

SEQ ID NO: 1264 - protein, 13 aa, Artificial Sequence
  MHC class II binding epitope
DFWLLKELQTWLW

SEQ ID NO: 1265 - protein, 13 aa, Artificial Sequence
  MHC class II binding epitope
FWLLKELQTWLWR

SEQ ID NO: 1266 - protein, 13 aa, Artificial Sequence
  MHC class II binding epitope
WLLKELQTWLWRS

SEQ ID NO: 1267 - protein, 13 aa, Artificial Sequence
  MHC class II binding epitope
KELQTWLWRSAKD

SEQ ID NO: 1268 - protein, 13 aa, Artificial Sequence
  MHC class II binding epitope
ELQTWLWRSAKDF

SEQ ID NO: 1269 - protein, 13 aa, Artificial Sequence
  MHC class II binding epitope
QTWLWRSAKDFNR

SEQ ID NO: 1270 - protein, 13 aa, Artificial Sequence
  MHC class II binding epitope
TWLWRSAKDFNRL

SEQ ID NO: 1271 - protein, 13 aa, Artificial Sequence
  MHC class II binding epitope
WLWRSAKDFNRLK

SEQ ID NO: 1272 - protein, 13 aa, Artificial Sequence
  MHC class II binding epitope
WRSAKDFNRLKKK

SEQ ID NO: 1273 - protein, 13 aa, Artificial Sequence
  MHC class II binding epitope
RSAKDFNRLKKKM

SEQ ID NO: 1274 - protein, 13 aa, Artificial Sequence
  MHC class II binding epitope
KDFNRLKKKMQPP

SEQ ID NO: 1275 - protein, 13 aa, Artificial Sequence
  MHC class II binding epitope
NRLKKKMQPPAAA

SEQ ID NO: 1276 - protein, 13 aa, Artificial Sequence
  MHC class II binding epitope
RLKKKMQPPAAAV

SEQ ID NO: 1277 - protein, 13 aa, Artificial Sequence
  MHC class II binding epitope
LKKKMQPPAAAVT

SEQ ID NO: 1278 - protein, 13 aa, Artificial Sequence
  MHC class II binding epitope
KKMQPPAAAVTLH

SEQ ID NO: 1279 - protein, 13 aa, Artificial Sequence
  MHC class II binding epitope
KMQPPAAAVTLHL

SEQ ID NO: 1280 - protein, 13 aa, Artificial Sequence
  MHC class II binding epitope
QPPAAAVTLHLGA

SEQ ID NO: 1281 - protein, 13 aa, Artificial Sequence
  MHC class II binding epitope
TAVISPQDPTLLI

SEQ ID NO: 1282 - protein, 13 aa, Artificial Sequence
  MHC class II binding epitope
AVISPQDPTLLIG

SEQ ID NO: 1283 - protein, 13 aa, Artificial Sequence
  MHC class II binding epitope
VISPQDPTLLIGS

SEQ ID NO: 1284 - protein, 13 aa, Artificial Sequence
  MHC class II binding epitope
QDPTLLIGSSLLA

SEQ ID NO: 1285 - protein, 13 aa, Artificial Sequence
  MHC class II binding epitope
DPTLLIGSSLLAT

SEQ ID NO: 1286 - protein, 13 aa, Artificial Sequence
  MHC class II binding epitope
PTLLIGSSLLATC

SEQ ID NO: 1287 - protein, 13 aa, Artificial Sequence
  MHC class II binding epitope
TLLIGSSLLATCS

SEQ ID NO: 1288 - protein, 13 aa, Artificial Sequence
  MHC class II binding epitope
LLIGSSLLATCSV

SEQ ID NO: 1289 - protein, 13 aa, Artificial Sequence
  MHC class II binding epitope
IGSSLLATCSVHG

SEQ ID NO: 1290 - protein, 13 aa, Artificial Sequence
  MHC class II binding epitope
SSLLATCSVHGDP

SEQ ID NO: 1291 - protein, 13 aa, Artificial Sequence
  MHC class II binding epitope
SLLATCSVHGDPP

SEQ ID NO: 1292 - protein, 13 aa, Artificial Sequence
  MHC class II binding epitope
CSVHGDPPGATAE

SEQ ID NO: 1293 - protein, 13 aa, Artificial Sequence
  MHC class II binding epitope
GDPPGATAEGLYW

SEQ ID NO: 1294 - protein, 13 aa, Artificial Sequence
  MHC class II binding epitope
EGLYWTLNGRRLP

SEQ ID NO: 1295 - protein, 13 aa, Artificial Sequence
  MHC class II binding epitope
GLYWTLNGRRLPP

SEQ ID NO: 1296 - protein, 13 aa, Artificial Sequence
  MHC class II binding epitope
WTLNGRRLPPELS

SEQ ID NO: 1297 - protein, 13 aa, Artificial Sequence
  MHC class II binding epitope
RRLPPELSRVLNA

SEQ ID NO: 1298 - protein, 13 aa, Artificial Sequence
  MHC class II binding epitope
RLPPELSRVLNAS

SEQ ID NO: 1299 - protein, 13 aa, Artificial Sequence
  MHC class II binding epitope
PELSRVLNASTLA

SEQ ID NO: 1300 - protein, 13 aa, Artificial Sequence
  MHC class II binding epitope
ELSRVLNASTLAL

SEQ ID NO: 1301 - protein, 13 aa, Artificial Sequence
  MHC class II binding epitope
LSRVLNASTLALA

SEQ ID NO: 1302 - protein, 13 aa, Artificial Sequence
  MHC class II binding epitope
SRVLNASTLALAL

SEQ ID NO: 1303 - protein, 13 aa, Artificial Sequence
  MHC class II binding epitope
RVLNASTLALALA

SEQ ID NO: 1304 - protein, 14 aa, Artificial Sequence
  MHC class II binding epitope
LNASTLALAALANL

SEQ ID NO: 1305 - protein, 13 aa, Artificial Sequence
  MHC class II binding epitope
NASTLALALANLN

SEQ ID NO: 1306 - protein, 13 aa, Artificial Sequence
  MHC class II binding epitope
STLALALANLNGS

SEQ ID NO: 1307 - protein, 13 aa, Artificial Sequence
  MHC class II binding epitope
LALALANLNGSRQ

SEQ ID NO: 1308 - protein, 13 aa, Artificial Sequence
  MHC class II binding epitope
LALANLNGSRQRS

SEQ ID NO: 1309 - protein, 13 aa, Artificial Sequence
  MHC class II binding epitope
ANLNGSRQRSGDN

SEQ ID NO: 1310 - protein, 13 aa, Artificial Sequence
  MHC class II binding epitope
DNLVCHARDGSIL

SEQ ID NO: 1311 - protein, 13 aa, Artificial Sequence
  MHC class II binding epitope
NLVCHARDGSILA

SEQ ID NO: 1312 - protein, 13 aa, Artificial Sequence
  MHC class II binding epitope
VCHARDGSILAGS

SEQ ID NO: 1313 - protein, 13 aa, Artificial Sequence
  MHC class II binding epitope
RDGSILAGSCLYV

SEQ ID NO: 1314 - protein, 13 aa, Artificial Sequence
  MHC class II binding epitope
DGSILAGSCLYVG

SEQ ID NO: 1315 - protein, 13 aa, Artificial Sequence
  MHC class II binding epitope
GSILAGSCLYVGL

SEQ ID NO: 1316 - protein, 13 aa, Artificial Sequence
  MHC class II binding epitope
SILAGSCLYVGLP

SEQ ID NO: 1317 - protein, 13 aa, Artificial Sequence
  MHC class II binding epitope
SCLYVGLPPEKPV

SEQ ID NO: 1318 - protein, 13 aa, Artificial Sequence
  MHC class II binding epitope
CLYVGLPPEKPVN

SEQ ID NO: 1319 - protein, 13 aa, Artificial Sequence
  MHC class II binding epitope
LYVGLPPEKPVNI

SEQ ID NO: 1320 - protein, 13 aa, Artificial Sequence
  MHC class II binding epitope
VGLPPEKPVNISC

SEQ ID NO: 1321 - protein, 13 aa, Artificial Sequence
  MHC class II binding epitope
KPVNISCWSKNMK

SEQ ID NO: 1322 - protein, 13 aa, Artificial Sequence
  MHC class II binding epitope
VNISCWSKNMKDL

SEQ ID NO: 1323 - protein, 13 aa, Artificial Sequence
  MHC class II binding epitope
KNMKDLTCRWTPG

SEQ ID NO: 1324 - protein, 13 aa, Artificial Sequence
  MHC class II binding epitope
KDLTCRWTPGAHG

SEQ ID NO: 1325 - protein, 13 aa, Artificial Sequence
  MHC class II binding epitope
CRWTPGAHGETFL

SEQ ID NO: 1326 - protein, 13 aa, Artificial Sequence
  MHC class II binding epitope
RWTPGAHGETFLH

SEQ ID NO: 1327 - protein, 13 aa, Artificial Sequence
  MHC class II binding epitope
HGETFLHTNYSLK

SEQ ID NO: 1328 - protein, 13 aa, Artificial Sequence
  MHC class II binding epitope
ETFLHTNYSLKYK

SEQ ID NO: 1329 - protein, 13 aa, Artificial Sequence
  MHC class II binding epitope
TFLHTNYSLKYKL

SEQ ID NO: 1330 - protein, 13 aa, Artificial Sequence
  MHC class II binding epitope
TNYSLKYKLRWYG

SEQ ID NO: 1331 - protein, 13 aa, Artificial Sequence
  MHC class II binding epitope
YSLKYKLRWYGQD

SEQ ID NO: 1332 - protein, 13 aa, Artificial Sequence
  MHC class II binding epitope
LKYKLRWYGQDNT

SEQ ID NO: 1333 - protein, 13 aa, Artificial Sequence
  MHC class II binding epitope
YKLRWYGQDNTCE

SEQ ID NO: 1334 - protein, 13 aa, Artificial Sequence
  MHC class II binding epitope
LRWYGQDNTCEEY

SEQ ID NO: 1335 - protein, 13 aa, Artificial Sequence
  MHC class II binding epitope
RWYGQDNTCEEYH

SEQ ID NO: 1336 - protein, 13 aa, Artificial Sequence
  MHC class II binding epitope
EEYHTVGPHSCHI

SEQ ID NO: 1337 - protein, 13 aa, Artificial Sequence
  MHC class II binding epitope
HTVGPHSCHIPKD

SEQ ID NO: 1338 - protein, 13 aa, Artificial Sequence
  MHC class II binding epitope
PHSCHIPKDLALF

SEQ ID NO: 1339 - protein, 13 aa, Artificial Sequence
  MHC class II binding epitope
CHIPKDLALFTPY

SEQ ID NO: 1340 - protein, 13 aa, Artificial Sequence
  MHC class II binding epitope
IPKDLALFTPYEI

SEQ ID NO: 1341 - protein, 13 aa, Artificial Sequence
  MHC class II binding epitope
KDLALFTPYEIWV

SEQ ID NO: 1342 - protein, 13 aa, Artificial Sequence
  MHC class II binding epitope
ALFTPYEIWVEAT

SEQ ID NO: 1343 - protein, 13 aa, Artificial Sequence
  MHC class II binding epitope
TPYEIWVEATNRL

SEQ ID NO: 1344 - protein, 13 aa, Artificial Sequence
  MHC class II binding epitope
YEIWVEATNRLGS

SEQ ID NO: 1345 - protein, 13 aa, Artificial Sequence
  MHC class II binding epitope
EIWVEATNRLGSA

SEQ ID NO: 1346 - protein, 13 aa, Artificial Sequence
  MHC class II binding epitope
IWVEATNRLGSAR

SEQ ID NO: 1347 - protein, 13 aa, Artificial Sequence
  MHC class II binding epitope
EIWVEATNRLGSA

SEQ ID NO: 1348 - protein, 13 aa, Artificial Sequence
  MHC class II binding epitope
NRLGSARSDVLTL

SEQ ID NO: 1349 - protein, 13 aa, Artificial Sequence
  MHC class II binding epitope
EATNRLGSARSDV

SEQ ID NO: 1350 - protein, 13 aa, Artificial Sequence
  MHC class II binding epitope
SARSDVLTLDILD

SEQ ID NO: 1351 - protein, 13 aa, Artificial Sequence
  MHC class II binding epitope
SDVLTLDILDVVT

SEQ ID NO: 1352 - protein, 13 aa, Artificial Sequence
  MHC class II binding epitope
DVLTLDILDVVTT

SEQ ID NO: 1353 - protein, 13 aa, Artificial Sequence
  MHC class II binding epitope
LTLDILDVVTTDP

SEQ ID NO: 1354 - protein, 13 aa, Artificial Sequence
  MHC class II binding epitope
LDILDVVTTDPPP

SEQ ID NO: 1355 - protein, 13 aa, Artificial Sequence
  MHC class II binding epitope
DILDVVTTDPPPD

SEQ ID NO: 1356 - protein, 13 aa, Artificial Sequence
  MHC class II binding epitope
LDVVTTDPPPDVH

SEQ ID NO: 1357 - protein, 13 aa, Artificial Sequence
  MHC class II binding epitope
ARSDVLTLDILDV

SEQ ID NO: 1358 - protein, 13 aa, Artificial Sequence
  MHC class II binding epitope
PDVHVSRVGGLED

SEQ ID NO: 1359 - protein, 13 aa, Artificial Sequence
  MHC class II binding epitope
VHVSRVGGLEDQL

SEQ ID NO: 1360 - protein, 13 aa, Artificial Sequence
  MHC class II binding epitope
SRVGGLEDQLSVR

SEQ ID NO: 1361 - protein, 13 aa, Artificial Sequence
  MHC class II binding epitope
DVVTTDPPPDVHV

SEQ ID NO: 1362 - protein, 13 aa, Artificial Sequence
  MHC class II binding epitope
GGLEDQLSVRWVS

SEQ ID NO: 1363 - protein, 13 aa, Artificial Sequence
  MHC class II binding epitope
RVGGLEDQLSVRW

SEQ ID NO: 1364 - protein, 13 aa, Artificial Sequence
  MHC class II binding epitope
DQLSVRWVSPPAL

SEQ ID NO: 1365 - protein, 13 aa, Artificial Sequence
  MHC class II binding epitope
LSVRWVSPPALKD

SEQ ID NO: 1366 - protein, 13 aa, Artificial Sequence
  MHC class II binding epitope
VRWVSPPALKDFL

SEQ ID NO: 1367 - protein, 13 aa, Artificial Sequence
  MHC class II binding epitope
RWVSPPALKDFLF

SEQ ID NO: 1368 - protein, 13 aa, Artificial Sequence
  MHC class II binding epitope
GLEDQLSVRWVSP

SEQ ID NO: 1369 - protein, 13 aa, Artificial Sequence
  MHC class II binding epitope
PALKDFLFQAKYQ

SEQ ID NO: 1370 - protein, 13 aa, Artificial Sequence
  MHC class II binding epitope
KDFLFQAKYQIRY

SEQ ID NO: 1371 - protein, 13 aa, Artificial Sequence
  MHC class II binding epitope
DFLFQAKYQIRYR

SEQ ID NO: 1372 - protein, 13 aa, Artificial Sequence
  MHC class II binding epitope
FLFQAKYQIRYRV

SEQ ID NO: 1373 - protein, 13 aa, Artificial Sequence
  MHC class II binding epitope
VSPPALKDFLFQA

SEQ ID NO: 1374 - protein, 13 aa, Artificial Sequence
  MHC class II binding epitope
AKYQIRYRVEDSV

SEQ ID NO: 1375 - protein, 13 aa, Artificial Sequence
  MHC class II binding epitope
YQIRYRVEDSVDW

SEQ ID NO: 1376 - protein, 13 aa, Artificial Sequence
  MHC class II binding epitope
IRYRVEDSVDWKV

SEQ ID NO: 1377 - protein, 13 aa, Artificial Sequence
  MHC class II binding epitope
YRVEDSVDWKVVD

SEQ ID NO: 1378 - protein, 13 aa, Artificial Sequence
  MHC class II binding epitope
FQAKYQIRYRVED

SEQ ID NO: 1379 - protein, 13 aa, Artificial Sequence
  MHC class II binding epitope
DSVDWKVVDDVSN

SEQ ID NO: 1380 - protein, 13 aa, Artificial Sequence
  MHC class II binding epitope
VDWKVVDDVSNQT

SEQ ID NO: 1381 - protein, 13 aa, Artificial Sequence
  MHC class II binding epitope
VEDSVDWKVVDDV

SEQ ID NO: 1382 - protein, 13 aa, Artificial Sequence
  MHC class II binding epitope
KVVDDVSNQTSCR

SEQ ID NO: 1383 - protein, 13 aa, Artificial Sequence
  MHC class II binding epitope
DDVSNQTSCRLAG

SEQ ID NO: 1384 - protein, 13 aa, Artificial Sequence
  MHC class II binding epitope
WKVVDDVSNQTSC

SEQ ID NO: 1385 - protein, 13 aa, Artificial Sequence
  MHC class II binding epitope
QTSCRLAGLKPGT

SEQ ID NO: 1386 - protein, 13 aa, Artificial Sequence
  MHC class II binding epitope
CRLAGLKPGTVYF

SEQ ID NO: 1387 - protein, 13 aa, Artificial Sequence
  MHC class II binding epitope
AGLKPGTVYFVQV

SEQ ID NO: 1388 - protein, 13 aa, Artificial Sequence
  MHC class II binding epitope
GTVYFVQVRCNPF

SEQ ID NO: 1389 - protein, 13 aa, Artificial Sequence
  MHC class II binding epitope
TVYFVQVRCNPFG

SEQ ID NO: 1390 - protein, 13 aa, Artificial Sequence
  MHC class II binding epitope
VYFVQVRCNPFGI

SEQ ID NO: 1391 - protein, 13 aa, Artificial Sequence
  MHC class II binding epitope
FVQVRCNPFGIYG

SEQ ID NO: 1392 - protein, 13 aa, Artificial Sequence
  MHC class II binding epitope
VQVRCNPFGIYGS

SEQ ID NO: 1393 - protein, 13 aa, Artificial Sequence
  MHC class II binding epitope
NPFGIYGSKKAGI

SEQ ID NO: 1394 - protein, 13 aa, Artificial Sequence
  MHC class II binding epitope
PFGIYGSKKAGIW

SEQ ID NO: 1395 - protein, 13 aa, Artificial Sequence
  MHC class II binding epitope
FGIYGSKKAGIWS

SEQ ID NO: 1396 - protein, 13 aa, Artificial Sequence
  MHC class II binding epitope
GIYGSKKAGIWSE

SEQ ID NO: 1397 - protein, 13 aa, Artificial Sequence
  MHC class II binding epitope
SKKAGIWSEWSHP

SEQ ID NO: 1398 - protein, 13 aa, Artificial Sequence
  MHC class II binding epitope
AGIWSEWSHPTAA

SEQ ID NO: 1399 - protein, 13 aa, Artificial Sequence
  MHC class II binding epitope
GIWSEWSHPTAAS

SEQ ID NO: 1400 - protein, 13 aa, Artificial Sequence
  MHC class II binding epitope
SEWSHPTAASTPR

SEQ ID NO: 1401 - protein, 13 aa, Artificial Sequence
  MHC class II binding epitope
SHPTAASTPRSER

SEQ ID NO: 1402 - protein, 13 aa, Artificial Sequence
  MHC class II binding epitope
PSSGPVRRELKQF

SEQ ID NO: 1403 - protein, 13 aa, Artificial Sequence
  MHC class II binding epitope
GPVRRELKQFLGW

SEQ ID NO: 1404 - protein, 13 aa, Artificial Sequence
  MHC class II binding epitope
RELKQFLGWLKKH

SEQ ID NO: 1405 - protein, 13 aa, Artificial Sequence
  MHC class II binding epitope
KQFLGWLKKHAYC

SEQ ID NO: 1406 - protein, 13 aa, Artificial Sequence
  MHC class II binding epitope
QFLGWLKKHAYCS

SEQ ID NO: 1407 - protein, 13 aa, Artificial Sequence
  MHC class II binding epitope
LGWLKKHAYCSNL

SEQ ID NO: 1408 - protein, 13 aa, Artificial Sequence
  MHC class II binding epitope
GWLKKHAYCSNLS

SEQ ID NO: 1409 - protein, 13 aa, Artificial Sequence
  MHC class II binding epitope
HAYCSNLSFRLYD

SEQ ID NO: 1410 - protein, 13 aa, Artificial Sequence
  MHC class II binding epitope
AYCSNLSFRLYDQ

SEQ ID NO: 1411 - protein, 13 aa, Artificial Sequence
  MHC class II binding epitope
SNLSFRLYDQWRA

SEQ ID NO: 1412 - protein, 13 aa, Artificial Sequence
  MHC class II binding epitope
LSFRLYDQWRAWM

SEQ ID NO: 1413 - protein, 13 aa, Artificial Sequence
  MHC class II binding epitope
FRLYDQWRAWMQK

SEQ ID NO: 1414 - protein, 13 aa, Artificial Sequence
  MHC class II binding epitope
RLYDQWRAWMQKS

SEQ ID NO: 1415 - protein, 13 aa, Artificial Sequence
  MHC class II binding epitope
DQWRAWMQKSHKT

SEQ ID NO: 1416 - protein, 13 aa, Artificial Sequence
  MHC class II binding epitope
RAWMQKSHKTRNQ

SEQ ID NO: 1417 - protein, 13 aa, Artificial Sequence
  MHC class II binding epitope
AWMQKSHKTRNQD

SEQ ID NO: 1418 - protein, 13 aa, Artificial Sequence
  MHC class II binding epitope
HKTRNQDEGILPS

SEQ ID NO: 1419 - protein, 13 aa, Artificial Sequence
  MHC class II binding epitope
EGILPSGRRGTAR

SEQ ID NO: 1420 - protein, 13 aa, Artificial Sequence
  MHC class II binding epitope
GILPSGRRGTARG

SEQ ID NO: 1421 - protein, 13 aa, Artificial Sequence
  MHC class II binding epitope
KTLQFFFLFCCWK

SEQ ID NO: 1422 - protein, 13 aa, Artificial Sequence
  MHC class II binding epitope
LQFFFLFCCWKAI

SEQ ID NO: 1423 - protein, 13 aa, Artificial Sequence
  MHC class II binding epitope
QFFFLFCCWKAIC

SEQ ID NO: 1424 - protein, 13 aa, Artificial Sequence
  MHC class II binding epitope
FFFLFCCWKAICC

SEQ ID NO: 1425 - protein, 13 aa, Artificial Sequence
  MHC class II binding epitope
FFLFCCWKAICCN

SEQ ID NO: 1426 - protein, 13 aa, Artificial Sequence
  MHC class II binding epitope
FLFCCWKAICCNS

SEQ ID NO: 1427 - protein, 13 aa, Artificial Sequence
  MHC class II binding epitope
CCWKAICCNSCEL

SEQ ID NO: 1428 - protein, 13 aa, Artificial Sequence
  MHC class II binding epitope
KAICCNSCELTNI

SEQ ID NO: 1429 - protein, 13 aa, Artificial Sequence
  MHC class II binding epitope
CELTNITIAIEKE

SEQ ID NO: 1430 - protein, 13 aa, Artificial Sequence
  MHC class II binding epitope
TNITIAIEKEECR

SEQ ID NO: 1431 - protein, 13 aa, Artificial Sequence
  MHC class II binding epitope
ITIAIEKEECRFC

SEQ ID NO: 1432 - protein, 13 aa, Artificial Sequence
  MHC class II binding epitope
IAIEKEECRFCIS

SEQ ID NO: 1433 - protein, 13 aa, Artificial Sequence
  MHC class II binding epitope
CRFCISINTTWCA

SEQ ID NO: 1434 - protein, 13 aa, Artificial Sequence
  MHC class II binding epitope
FCISINTTWCAGY

SEQ ID NO: 1435 - protein, 13 aa, Artificial Sequence
  MHC class II binding epitope
ISINTTWCAGYCY

SEQ ID NO: 1436 - protein, 13 aa, Artificial Sequence
  MHC class II binding epitope
TTWCAGYCYTRDL

SEQ ID NO: 1437 - protein, 13 aa, Artificial Sequence
  MHC class II binding epitope
AGYCYTRDLVYKD

SEQ ID NO: 1438 - protein, 13 aa, Artificial Sequence
  MHC class II binding epitope
YCYTRDLVYKDPA

SEQ ID NO: 1439 - protein, 13 aa, Artificial Sequence
  MHC class II binding epitope
RDLVYKDPARPKI

SEQ ID NO: 1440 - protein, 13 aa, Artificial Sequence
  MHC class II binding epitope
DLVYKDPARPKIQ

SEQ ID NO: 1441 - protein, 13 aa, Artificial Sequence
  MHC class II binding epitope
LVYKDPARPKIQK

SEQ ID NO: 1442 - protein, 13 aa, Artificial Sequence
  MHC class II binding epitope
PKIQKTCTFKELV

SEQ ID NO: 1443 - protein, 13 aa, Artificial Sequence
  MHC class II binding epitope
CTFKELVYETVRV

SEQ ID NO: 1444 - protein, 13 aa, Artificial Sequence
  MHC class II binding epitope
KELVYETVRVPGC

SEQ ID NO: 1445 - protein, 13 aa, Artificial Sequence
  MHC class II binding epitope
ELVYETVRVPGCA

SEQ ID NO: 1446 - protein, 13 aa, Artificial Sequence
  MHC class II binding epitope
LVYETVRVPGCAH

SEQ ID NO: 1447 - protein, 13 aa, Artificial Sequence
  MHC class II binding epitope
ETVRVPGCAHHAD

SEQ ID NO: 1448 - protein, 13 aa, Artificial Sequence
  MHC class II binding epitope
VRVPGCAHHADSL

SEQ ID NO: 1449 - protein, 13 aa, Artificial Sequence
  MHC class II binding epitope
DSLYTYPVATQCH

SEQ ID NO: 1450 - protein, 13 aa, Artificial Sequence
  MHC class II binding epitope
SLYTYPVATQCHC

SEQ ID NO: 1451 - protein, 13 aa, Artificial Sequence
  MHC class II binding epitope
YTYPVATQCHCGK

SEQ ID NO: 1452 - protein, 13 aa, Artificial Sequence
  MHC class II binding epitope
YPVATQCHCGKCD

SEQ ID NO: 1453 - protein, 13 aa, Artificial Sequence
  MHC class II binding epitope
CTVRGLGPSYCSF

SEQ ID NO: 1454 - protein, 13 aa, Artificial Sequence
  MHC class II binding epitope
RGLGPSYCSFGEM

SEQ ID NO: 1455 - protein, 13 aa, Artificial Sequence
  MHC class II binding epitope
KQYPIINFTTAGA

SEQ ID NO: 1456 - protein, 13 aa, Artificial Sequence
  MHC class II binding epitope
YPIINFTTAGATV

SEQ ID NO: 1457 - protein, 13 aa, Artificial Sequence
  MHC class II binding epitope
PIINFTTAGATVQ

SEQ ID NO: 1458 - protein, 13 aa, Artificial Sequence
  MHC class II binding epitope
INFTTAGATVQSY

SEQ ID NO: 1459 - protein, 13 aa, Artificial Sequence
  MHC class II binding epitope
ATVQSYTNFIRAV

SEQ ID NO: 1460 - protein, 13 aa, Artificial Sequence
  MHC class II binding epitope
QSYTNFIRAVRGR

SEQ ID NO: 1461 - protein, 13 aa, Artificial Sequence
  MHC class II binding epitope
TNFIRAVRGRLTT

SEQ ID NO: 1462 - protein, 13 aa, Artificial Sequence
  MHC class II binding epitope
NFIRAVRGRLTTG

SEQ ID NO: 1463 - protein, 13 aa, Artificial Sequence
  MHC class II binding epitope
RAVRGRLTTGADV

SEQ ID NO: 1464 - protein, 13 aa, Artificial Sequence
  MHC class II binding epitope
GRLTTGADVRHEI

SEQ ID NO: 1465 - protein, 13 aa, Artificial Sequence
  MHC class II binding epitope
ADVRHEIPVLPNR

SEQ ID NO: 1466 - protein, 13 aa, Artificial Sequence
  MHC class II binding epitope
HEIPVLPNRVGLP

SEQ ID NO: 1467 - protein, 13 aa, Artificial Sequence
  MHC class II binding epitope
IPVLPNRVGLPIN

SEQ ID NO: 1468 - protein, 13 aa, Artificial Sequence
  MHC class II binding epitope
PVLPNRVGLPINQ

SEQ ID NO: 1469 - protein, 13 aa, Artificial Sequence
  MHC class II binding epitope
NRVGLPINQRFIL

SEQ ID NO: 1470 - protein, 13 aa, Artificial Sequence
  MHC class II binding epitope
VGLPINQRFILVE

SEQ ID NO: 1471 - protein, 13 aa, Artificial Sequence
  MHC class II binding epitope
LPINQRFILVELS

SEQ ID NO: 1472 - protein, 13 aa, Artificial Sequence
  MHC class II binding epitope
QRFILVELSNHAE

SEQ ID NO: 1473 - protein, 13 aa, Artificial Sequence
  MHC class II binding epitope
RFILVELSNHAEL

SEQ ID NO: 1474 - protein, 13 aa, Artificial Sequence
  MHC class II binding epitope
FILVELSNHAELS

SEQ ID NO: 1475 - protein, 13 aa, Artificial Sequence
  MHC class II binding epitope
ILVELSNHAELSV

SEQ ID NO: 1476 - protein, 13 aa, Artificial Sequence
  MHC class II binding epitope
VELSNHAELSVTL

SEQ ID NO: 1477 - protein, 13 aa, Artificial Sequence
  MHC class II binding epitope
AELSVTLALDVTN

SEQ ID NO: 1478 - protein, 13 aa, Artificial Sequence
  MHC class II binding epitope
LSVTLALDVTNAY

SEQ ID NO: 1479 - protein, 13 aa, Artificial Sequence
  MHC class II binding epitope
VTLALDVTNAYVV

SEQ ID NO: 1480 - protein, 13 aa, Artificial Sequence
  MHC class II binding epitope
LALDVTNAYVVGY

SEQ ID NO: 1481 - protein, 13 aa, Artificial Sequence
  MHC class II binding epitope
LDVTNAYVVGYRA

SEQ ID NO: 1482 - protein, 13 aa, Artificial Sequence
  MHC class II binding epitope
NAYVVGYRAGNSA

SEQ ID NO: 1483 - protein, 13 aa, Artificial Sequence
  MHC class II binding epitope
AYVVGYRAGNSAY

SEQ ID NO: 1484 - protein, 13 aa, Artificial Sequence
  MHC class II binding epitope
YVVGYRAGNSAYF

SEQ ID NO: 1485 - protein, 13 aa, Artificial Sequence
  MHC class II binding epitope
VGYRAGNSAYFFH

SEQ ID NO: 1486 - protein, 13 aa, Artificial Sequence
  MHC class II binding epitope
SAYFFHPDNQEDA

SEQ ID NO: 1487 - protein, 13 aa, Artificial Sequence
  MHC class II binding epitope
AYFFHPDNQEDAE

SEQ ID NO: 1488 - protein, 13 aa, Artificial Sequence
  MHC class II binding epitope
YFFHPDNQEDAEA

SEQ ID NO: 1489 - protein, 13 aa, Artificial Sequence
  MHC class II binding epitope
EAITHLFTDVQNR

SEQ ID NO: 1490 - protein, 13 aa, Artificial Sequence
  MHC class II binding epitope
THLFTDVQNRYTF

SEQ ID NO: 1491 - protein, 13 aa, Artificial Sequence
  MHC class II binding epitope
HLFTDVQNRYTFA

SEQ ID NO: 1492 - protein, 13 aa, Artificial Sequence
  MHC class II binding epitope
TDVQNRYTFAFGG

SEQ ID NO: 1493 - protein, 13 aa, Artificial Sequence
  MHC class II binding epitope
NRYTFAFGGNYDR

SEQ ID NO: 1494 - protein, 13 aa, Artificial Sequence
  MHC class II binding epitope
YTFAFGGNYDRLE

SEQ ID NO: 1495 - protein, 13 aa, Artificial Sequence
  MHC class II binding epitope
FAFGGNYDRLEQL

SEQ ID NO: 1496 - protein, 13 aa, Artificial Sequence
  MHC class II binding epitope
GNYDRLEQLAGNL

SEQ ID NO: 1497 - protein, 13 aa, Artificial Sequence
  MHC class II binding epitope
DRLEQLAGNLREN

SEQ ID NO: 1498 - protein, 13 aa, Artificial Sequence
  MHC class II binding epitope
EQLAGNLRENIEL

SEQ ID NO: 1499 - protein, 13 aa, Artificial Sequence
  MHC class II binding epitope
GNLRENIELGNGP

SEQ ID NO: 1500 - protein, 13 aa, Artificial Sequence
  MHC class II binding epitope
ENIELGNGPLEEA

SEQ ID NO: 1501 - protein, 13 aa, Artificial Sequence
  MHC class II binding epitope
IELGNGPLEEAIS

SEQ ID NO: 1502 - protein, 13 aa, Artificial Sequence
  MHC class II binding epitope
GPLEEAISALYYY

SEQ ID NO: 1503 - protein, 13 aa, Artificial Sequence
  MHC class II binding epitope
EAISALYYYSTGG

SEQ ID NO: 1504 - protein, 13 aa, Artificial Sequence
  MHC class II binding epitope
SALYYYSTGGTQL

SEQ ID NO: 1505 - protein, 13 aa, Artificial Sequence
  MHC class II binding epitope
ALYYYSTGGTQLP

SEQ ID NO: 1506 - protein, 13 aa, Artificial Sequence
  MHC class II binding epitope
LYYYSTGGTQLPT

SEQ ID NO: 1507 - protein, 13 aa, Artificial Sequence
  MHC class II binding epitope
YYYSTGGTQLPTL

SEQ ID NO: 1508 - protein, 13 aa, Artificial Sequence
  MHC class II binding epitope
TQLPTLARSFIIC

SEQ ID NO: 1509 - protein, 13 aa, Artificial Sequence
  MHC class II binding epitope
PTLARSFIICIQM

SEQ ID NO: 1510 - protein, 13 aa, Artificial Sequence
  MHC class II binding epitope
RSFIICIQMISEA

SEQ ID NO: 1511 - protein, 13 aa, Artificial Sequence
  MHC class II binding epitope
SFIICIQMISEAA

SEQ ID NO: 1512 - protein, 13 aa, Artificial Sequence
  MHC class II binding epitope
FIICIQMISEAAR

SEQ ID NO: 1513 - protein, 13 aa, Artificial Sequence
  MHC class II binding epitope
ICIQMISEAARFQ

SEQ ID NO: 1514 - protein, 13 aa, Artificial Sequence
  MHC class II binding epitope
IQMISEAARFQYI

SEQ ID NO: 1515 - protein, 13 aa, Artificial Sequence
  MHC class II binding epitope
QMISEAARFQYIE

SEQ ID NO: 1516 - protein, 13 aa, Artificial Sequence
  MHC class II binding epitope
ARFQYIEGEMRTR

SEQ ID NO: 1517 - protein, 13 aa, Artificial Sequence
  MHC class II binding epitope
FQYIEGEMRTRIR

SEQ ID NO: 1518 - protein, 13 aa, Artificial Sequence
  MHC class II binding epitope
QYIEGEMRTRIRY

SEQ ID NO: 1519 - protein, 13 aa, Artificial Sequence
  MHC class II binding epitope
GEMRTRIRYNRRS

SEQ ID NO: 1520 - protein, 13 aa, Artificial Sequence
  MHC class II binding epitope
TRIRYNRRSAPDP

SEQ ID NO: 1521 - protein, 13 aa, Artificial Sequence
  MHC class II binding epitope
IRYNRRSAPDPSV

SEQ ID NO: 1522 - protein, 13 aa, Artificial Sequence
  MHC class II binding epitope
PSVITLENSWGRL

SEQ ID NO: 1523 - protein, 13 aa, Artificial Sequence
  MHC class II binding epitope
SVITLENSWGRLS

SEQ ID NO: 1524 - protein, 13 aa, Artificial Sequence
  MHC class II binding epitope
ITLENSWGRLSTA

SEQ ID NO: 1525 - protein, 13 aa, Artificial Sequence
  MHC class II binding epitope
NSWGRLSTAIQES

SEQ ID NO: 1526 - protein, 13 aa, Artificial Sequence
  MHC class II binding epitope
GRLSTAIQESNQG

SEQ ID NO: 1527 - protein, 13 aa, Artificial Sequence
  MHC class II binding epitope
TAIQESNQGAFAS

SEQ ID NO: 1528 - protein, 13 aa, Artificial Sequence
  MHC class II binding epitope
GAFASPIQLQRRN

SEQ ID NO: 1529 - protein, 13 aa, Artificial Sequence
  MHC class II binding epitope
SPIQLQRRNGSKF

SEQ ID NO: 1530 - protein, 13 aa, Artificial Sequence
  MHC class II binding epitope
IQLQRRNGSKFSV

SEQ ID NO: 1531 - protein, 13 aa, Artificial Sequence
  MHC class II binding epitope
SKFSVYDVSILIP

SEQ ID NO: 1532 - protein, 13 aa, Artificial Sequence
  MHC class II binding epitope
FSVYDVSILIPII

SEQ ID NO: 1533 - protein, 13 aa, Artificial Sequence
  MHC class II binding epitope
SVYDVSILIPIIA

SEQ ID NO: 1534 - protein, 13 aa, Artificial Sequence
  MHC class II binding epitope
YDVSILIPIIALM

SEQ ID NO: 1535 - protein, 13 aa, Artificial Sequence
  MHC class II binding epitope
VSILIPIIALMVY

SEQ ID NO: 1536 - protein, 13 aa, Artificial Sequence
  MHC class II binding epitope
SILIPIIALMVYR

SEQ ID NO: 1537 - protein, 13 aa, Artificial Sequence
  MHC class II binding epitope
IPIIALMVYRCAP

SEQ ID NO: 1538 - protein, 13 aa, Artificial Sequence
  MHC class II binding epitope
IALMVYRCAPPPS

SEQ ID NO: 1539 - protein, 13 aa, Artificial Sequence
  MHC class II binding epitope
ALMVYRCAPPPSS

SEQ ID NO: 1540 - protein, 13 aa, Artificial Sequence
  MHC class II binding epitope
LMVYRCAPPPSSQ

SEQ ID NO: 1541 - protein, 13 aa, Artificial Sequence
  MHC class II binding epitope
MVYRCAPPPSSQF

SEQ ID NO: 1542 - protein, 13 aa, Artificial Sequence
  MHC class II binding epitope
DDVTTTEELAPAL

SEQ ID NO: 1543 - protein, 13 aa, Artificial Sequence
  MHC class II binding epitope
TTTEELAPALVPP

SEQ ID NO: 1544 - protein, 13 aa, Artificial Sequence
  MHC class II binding epitope
EELAPALVPPPKG

SEQ ID NO: 1545 - protein, 13 aa, Artificial Sequence
  MHC class II binding epitope
LAPALVPPPKGTC

SEQ ID NO: 1546 - protein, 13 aa, Artificial Sequence
  MHC class II binding epitope
PALVPPPKGTCAG

SEQ ID NO: 1547 - protein, 13 aa, Artificial Sequence
  MHC class II binding epitope
ALVPPPKGTCAGW

SEQ ID NO: 1548 - protein, 13 aa, Artificial Sequence
  MHC class II binding epitope
AGWMAGIPGHPGH

SEQ ID NO: 1549 - protein, 13 aa, Artificial Sequence
  MHC class II binding epitope
GWMAGIPGHPGHN

SEQ ID NO: 1550 - protein, 13 aa, Artificial Sequence
  MHC class II binding epitope
AGIPGHPGHNGTP

SEQ ID NO: 1551 - protein, 13 aa, Artificial Sequence
  MHC class II binding epitope
GTPGRDGRDGTPG

SEQ ID NO: 1552 - protein, 13 aa, Artificial Sequence
  MHC class II binding epitope
GDAGLLGPKGETG

SEQ ID NO: 1553 - protein, 13 aa, Artificial Sequence
  MHC class II binding epitope
AGLLGPKGETGDV

SEQ ID NO: 1554 - protein, 13 aa, Artificial Sequence
  MHC class II binding epitope
GLLGPKGETGDVG

SEQ ID NO: 1555 - protein, 13 aa, Artificial Sequence
  MHC class II binding epitope
GETGDVGMTGAEG

SEQ ID NO: 1556 - protein, 13 aa, Artificial Sequence
  MHC class II binding epitope
GDVGMTGAEGPRG

SEQ ID NO: 1557 - protein, 13 aa, Artificial Sequence
  MHC class II binding epitope
VGMTGAEGPRGFP

SEQ ID NO: 1558 - protein, 13 aa, Artificial Sequence
  MHC class II binding epitope
RGFPGTPGRKGEP

SEQ ID NO: 1559 - protein, 13 aa, Artificial Sequence
  MHC class II binding epitope
TPGRKGEPGEAAY

SEQ ID NO: 1560 - protein, 13 aa, Artificial Sequence
  MHC class II binding epitope
GRKGEPGEAAYMY

SEQ ID NO: 1561 - protein, 13 aa, Artificial Sequence
  MHC class II binding epitope
AAYMYRSAFSVGL

SEQ ID NO: 1562 - protein, 13 aa, Artificial Sequence
  MHC class II binding epitope
AYMYRSAFSVGLE

SEQ ID NO: 1563 - protein, 13 aa, Artificial Sequence
  MHC class II binding epitope
YMYRSAFSVGLET

SEQ ID NO: 1564 - protein, 13 aa, Artificial Sequence
  MHC class II binding epitope
SAFSVGLETRVTV

SEQ ID NO: 1565 - protein, 13 aa, Artificial Sequence
  MHC class II binding epitope
FSVGLETRVTVPN

SEQ ID NO: 1566 - protein, 13 aa, Artificial Sequence
  MHC class II binding epitope
VGLETRVTVPNVP

SEQ ID NO: 1567 - protein, 13 aa, Artificial Sequence
  MHC class II binding epitope
GLETRVTVPNVPI

SEQ ID NO: 1568 - protein, 13 aa, Artificial Sequence
  MHC class II binding epitope
ETRVTVPNVPIRF

SEQ ID NO: 1569 - protein, 13 aa, Artificial Sequence
  MHC class II binding epitope
TRVTVPNVPIRFT

SEQ ID NO: 1570 - protein, 13 aa, Artificial Sequence
  MHC class II binding epitope
VTVPNVPIRFTKI

SEQ ID NO: 1571 - protein, 13 aa, Artificial Sequence
  MHC class II binding epitope
VPNVPIRFTKIFY

SEQ ID NO: 1572 - protein, 13 aa, Artificial Sequence
  MHC class II binding epitope
PNVPIRFTKIFYN

SEQ ID NO: 1573 - protein, 13 aa, Artificial Sequence
  MHC class II binding epitope
VPIRFTKIFYNQQ

SEQ ID NO: 1574 - protein, 13 aa, Artificial Sequence
  MHC class II binding epitope
IRFTKIFYNQQNH

SEQ ID NO: 1575 - protein, 13 aa, Artificial Sequence
  MHC class II binding epitope
RFTKIFYNQQNHY

SEQ ID NO: 1576 - protein, 13 aa, Artificial Sequence
  MHC class II binding epitope
TKIFYNQQNHYDG

SEQ ID NO: 1577 - protein, 13 aa, Artificial Sequence
  MHC class II binding epitope
KIFYNQQNHYDGS

SEQ ID NO: 1578 - protein, 13 aa, Artificial Sequence
  MHC class II binding epitope
IFYNQQNHYDGST

SEQ ID NO: 1579 - protein, 13 aa, Artificial Sequence
  MHC class II binding epitope
QQNHYDGSTGKFY

SEQ ID NO: 1580 - protein, 13 aa, Artificial Sequence
  MHC class II binding epitope
NHYDGSTGKFYCN

SEQ ID NO: 1581 - protein, 13 aa, Artificial Sequence
  MHC class II binding epitope
GKFYCNIPGLYYF

SEQ ID NO: 1582 - protein, 13 aa, Artificial Sequence
  MHC class II binding epitope
KFYCNIPGLYYFS

SEQ ID NO: 1583 - protein, 13 aa, Artificial Sequence
  MHC class II binding epitope
CNIPGLYYFSYHI

SEQ ID NO: 1584 - protein, 13 aa, Artificial Sequence
  MHC class II binding epitope
PLYGYFSYHITVY

SEQ ID NO: 1585 - protein, 13 aa, Artificial Sequence
  MHC class II binding epitope
GLYYFSYHITVYM

SEQ ID NO: 1586 - protein, 13 aa, Artificial Sequence
  MHC class II binding epitope
LYYFSYHITVYMK

SEQ ID NO: 1587 - protein, 13 aa, Artificial Sequence
  MHC class II binding epitope
YYFSYHITVYMKD

SEQ ID NO: 1588 - protein, 13 aa, Artificial Sequence
  MHC class II binding epitope
FSYHITVYMKDVK

SEQ ID NO: 1589 - protein, 13 aa, Artificial Sequence
  MHC class II binding epitope
SYHITVYMKDVKV

SEQ ID NO: 1590 - protein, 13 aa, Artificial Sequence
  MHC class II binding epitope
YHITVYMKDVKVS

SEQ ID NO: 1591 - protein, 13 aa, Artificial Sequence
  MHC class II binding epitope
HITVYMKDVKVSL

SEQ ID NO: 1592 - protein, 13 aa, Artificial Sequence
  MHC class II binding epitope
ITVYMKDVKVSLF

SEQ ID NO: 1593 - protein, 13 aa, Artificial Sequence
  MHC class II binding epitope
TVYMKDVKVSLFK

SEQ ID NO: 1594 - protein, 13 aa, Artificial Sequence
  MHC class II binding epitope
VYMKDVKVSLFKK

SEQ ID NO: 1595 - protein, 13 aa, Artificial Sequence
  MHC class II binding epitope
KDVKVSLFKKDKA

SEQ ID NO: 1596 - protein, 13 aa, Artificial Sequence
  MHC class II binding epitope
VKVSLFKKDKAVL

SEQ ID NO: 1597 - protein, 13 aa, Artificial Sequence
  MHC class II binding epitope
VSLFKKDKAVLFT

SEQ ID NO: 1598 - protein, 13 aa, Artificial Sequence
  MHC class II binding epitope
SLFKKDKAVLFTY

SEQ ID NO: 1599 - protein, 13 aa, Artificial Sequence
  MHC class II binding epitope
FKKDKAVLFTYDQ

SEQ ID NO: 1600 - protein, 13 aa, Artificial Sequence
  MHC class II binding epitope
KDKAVLFTYDQYQ

SEQ ID NO: 1601 - protein, 13 aa, Artificial Sequence
  MHC class II binding epitope
KAVLFTYDQYQEK

SEQ ID NO: 1602 - protein, 13 aa, Artificial Sequence
  MHC class II binding epitope
AVLFTYDQYQEKN

SEQ ID NO: 1603 - protein, 13 aa, Artificial Sequence
  MHC class II binding epitope
VLFTYDQYQEKNV

SEQ ID NO: 1604 - protein, 13 aa, Artificial Sequence
  MHC class II binding epitope
FTYDQYQEKNVDQ

SEQ ID NO: 1605 - protein, 13 aa, Artificial Sequence
  MHC class II binding epitope
YDQYQEKNVDQAS

SEQ ID NO: 1606 - protein, 13 aa, Artificial Sequence
  MHC class II binding epitope
DQYQEKNVDQASG

SEQ ID NO: 1607 - protein, 13 aa, Artificial Sequence
  MHC class II binding epitope
EKNVDQASGSVLL

SEQ ID NO: 1608 - protein, 13 aa, Artificial Sequence
  MHC class II binding epitope
KNVDQASGSVLLH

SEQ ID NO: 1609 - protein, 13 aa, Artificial Sequence
  MHC class II binding epitope
ASGSVLLHLEVGD

SEQ ID NO: 1610 - protein, 13 aa, Artificial Sequence
  MHC class II binding epitope
GSVLLHLEVGDQV

SEQ ID NO: 1611 - protein, 13 aa, Artificial Sequence
  MHC class II binding epitope
SVLLHLEVGDQVW

SEQ ID NO: 1612 - protein, 13 aa, Artificial Sequence
  MHC class II binding epitope
VLLHLEVGDQVWL

SEQ ID NO: 1613 - protein, 13 aa, Artificial Sequence
  MHC class II binding epitope
LHLEVGDQVWLQV

SEQ ID NO: 1614 - protein, 13 aa, Artificial Sequence
  MHC class II binding epitope
LEVGDQVWLQVYG

SEQ ID NO: 1615 - protein, 13 aa, Artificial Sequence
  MHC class II binding epitope
DQVWLQVYGDGDH

SEQ ID NO: 1616 - protein, 13 aa, Artificial Sequence
  MHC class II binding epitope
QVWLQVYGDGDHN

SEQ ID NO: 1617 - protein, 13 aa, Artificial Sequence
  MHC class II binding epitope
VWLQVYGDGDHNG

SEQ ID NO: 1618 - protein, 13 aa, Artificial Sequence
  MHC class II binding epitope
LQVYGDGDHNGLY

SEQ ID NO: 1619 - protein, 13 aa, Artificial Sequence
  MHC class II binding epitope
QVYGDGDHNGLYA

SEQ ID NO: 1620 - protein, 13 aa, Artificial Sequence
  MHC class II binding epitope
VYGDGDHNGLYAD

SEQ ID NO: 1621 - protein, 13 aa, Artificial Sequence
  MHC class II binding epitope
GDHNGLYADNVND

SEQ ID NO: 1622 - protein, 13 aa, Artificial Sequence
  MHC class II binding epitope
NGLYADNVNDSTF

SEQ ID NO: 1623 - protein, 13 aa, Artificial Sequence
  MHC class II binding epitope
GLYADNVNDSTFT

SEQ ID NO: 1624 - protein, 13 aa, Artificial Sequence
  MHC class II binding epitope
LYADNVNDSTFTG

SEQ ID NO: 1625 - protein, 13 aa, Artificial Sequence
  MHC class II binding epitope
DNVNDSTFTGFLL

SEQ ID NO: 1626 - protein, 13 aa, Artificial Sequence
  MHC class II binding epitope
VNDSTFTGFLLYH

SEQ ID NO: 1627 - protein, 13 aa, Artificial Sequence
  MHC class II binding epitope
STFTGFLLYHDTN

SEQ ID NO: 1628 - protein, 13 aa, Artificial Sequence
  MHC class II binding epitope
PGVLLPLPKGACT

SEQ ID NO: 1629 - protein, 13 aa, Artificial Sequence
  MHC class II binding epitope
GVLLPLPKGACTG

SEQ ID NO: 1630 - protein, 13 aa, Artificial Sequence
  MHC class II binding epitope
VLLPLPKGACTGW

SEQ ID NO: 1631 - protein, 13 aa, Artificial Sequence
  MHC class II binding epitope
LPLPKGACTGWMA

SEQ ID NO: 1632 - protein, 13 aa, Artificial Sequence
  MHC class II binding epitope
PLPKGACTGWMAG

SEQ ID NO: 1633 - protein, 13 aa, Artificial Sequence
  MHC class II binding epitope
TGWMAGIPGHPGH

SEQ ID NO: 1634 - protein, 13 aa, Artificial Sequence
  MHC class II binding epitope
GWMAGIPGHPGHN

SEQ ID NO: 1635 - protein, 13 aa, Artificial Sequence
  MHC class II binding epitope
AGIPGHPGHNGAP

SEQ ID NO: 1636 - protein, 13 aa, Artificial Sequence
  MHC class II binding epitope
GAPGRDGRDGTPG

SEQ ID NO: 1637 - protein, 13 aa, Artificial Sequence
  MHC class II binding epitope
GDPGLIGPKGDIG

SEQ ID NO: 1638 - protein, 13 aa, Artificial Sequence
  MHC class II binding epitope
PGLIGPKGDIGET

SEQ ID NO: 1639 - protein, 13 aa, Artificial Sequence
  MHC class II binding epitope
GLIGPKGDIGETG

SEQ ID NO: 1640 - protein, 13 aa, Artificial Sequence
  MHC class II binding epitope
GPKGDIGETGVPG

SEQ ID NO: 1641 - protein, 13 aa, Artificial Sequence
  MHC class II binding epitope
GDIGETGVPGAEG

SEQ ID NO: 1642 - protein, 13 aa, Artificial Sequence
  MHC class II binding epitope
TGVPGAEGPRGFP

SEQ ID NO: 1643 - protein, 13 aa, Artificial Sequence
  MHC class II binding epitope
RGFPGIQGRKGEP

SEQ ID NO: 1644 - protein, 13 aa, Artificial Sequence
  MHC class II binding epitope
PGIQGRKGEPGEG

SEQ ID NO: 1645 - protein, 13 aa, Artificial Sequence
  MHC class II binding epitope
GRKGEPGEGAYVY

SEQ ID NO: 1646 - protein, 13 aa, Artificial Sequence
  MHC class II binding epitope
GAYVYRSAFSVGL

SEQ ID NO: 1647 - protein, 13 aa, Artificial Sequence
  MHC class II binding epitope
AYVYRSAFSVGLE

SEQ ID NO: 1648 - protein, 13 aa, Artificial Sequence
  MHC class II binding epitope
YVYRSAFSVGLET

SEQ ID NO: 1649 - protein, 13 aa, Artificial Sequence
  MHC class II binding epitope
RSAFSVGLETYVT

SEQ ID NO: 1650 - protein, 13 aa, Artificial Sequence
  MHC class II binding epitope
SAFSVGLETYVTI

SEQ ID NO: 1651 - protein, 13 aa, Artificial Sequence
  MHC class II binding epitope
AFSVGLETYVTIP

SEQ ID NO: 1652 - protein, 13 aa, Artificial Sequence
  MHC class II binding epitope
FSVGLETYVTIPN

SEQ ID NO: 1653 - protein, 13 aa, Artificial Sequence
  MHC class II binding epitope
VGLETYVTIPNMP

SEQ ID NO: 1654 - protein, 13 aa, Artificial Sequence
  MHC class II binding epitope
GLETYVTIPNMPI

SEQ ID NO: 1655 - protein, 13 aa, Artificial Sequence
  MHC class II binding epitope
ETYVTIPNMPIRF

SEQ ID NO: 1656 - protein, 13 aa, Artificial Sequence
  MHC class II binding epitope
TYVTIPNMPIRFT

SEQ ID NO: 1657 - protein, 13 aa, Artificial Sequence
  MHC class II binding epitope
VTIPNMPIRFTKI

SEQ ID NO: 1658 - protein, 13 aa, Artificial Sequence
  MHC class II binding epitope
IPNMPIRFTKIFY

SEQ ID NO: 1659 - protein, 13 aa, Artificial Sequence
  MHC class II binding epitope
PNMPIRFTKIFYN

SEQ ID NO: 1660 - protein, 13 aa, Artificial Sequence
  MHC class II binding epitope
MPIRFTKIFYNQQ

SEQ ID NO: 1661 - protein, 13 aa, Artificial Sequence
  MHC class II binding epitope
IRFTKIFYNQQNH

SEQ ID NO: 1662 - protein, 13 aa, Artificial Sequence
  MHC class II binding epitope
RFTKIFYNQQNHY

SEQ ID NO: 1663 - protein, 13 aa, Artificial Sequence
  MHC class II binding epitope
TKIFYNQQNHYDG

SEQ ID NO: 1664 - protein, 13 aa, Artificial Sequence
  MHC class II binding epitope
KIFYNQQNHYDGS

SEQ ID NO: 1665 - protein, 13 aa, Artificial Sequence
  MHC class II binding epitope
IFYNQQNHYDGST

SEQ ID NO: 1666 - protein, 13 aa, Artificial Sequence
  MHC class II binding epitope
QQNHYDGSTGKFH

SEQ ID NO: 1667 - protein, 13 aa, Artificial Sequence
  MHC class II binding epitope
NHYDGSTGKFHCN

SEQ ID NO: 1668 - protein, 13 aa, Artificial Sequence
  MHC class II binding epitope
GKFHCNIPGLYYF

SEQ ID NO: 1669 - protein, 13 aa, Artificial Sequence
  MHC class II binding epitope
CNIPGLYYFAYHI

SEQ ID NO: 1670 - protein, 13 aa, Artificial Sequence
  MHC class II binding epitope
PGLYYFAYHITVY

SEQ ID NO: 1671 - protein, 13 aa, Artificial Sequence
  MHC class II binding epitope
GLYYFAYHITVYM

SEQ ID NO: 1672 - protein, 13 aa, Artificial Sequence
  MHC class II binding epitope
LYYFAYHITVYMK

SEQ ID NO: 1673 - protein, 13 aa, Artificial Sequence
  MHC class II binding epitope
YYFAYHITVYMKD

SEQ ID NO: 1674 - protein, 13 aa, Artificial Sequence
  MHC class II binding epitope
FAYHITVYMKDVK

SEQ ID NO: 1675 - protein, 13 aa, Artificial Sequence
  MHC class II binding epitope
AYHITVYMKDVKV

SEQ ID NO: 1676 - protein, 13 aa, Artificial Sequence
  MHC class II binding epitope
YHITVYMKDVKVS

SEQ ID NO: 1677 - protein, 13 aa, Artificial Sequence
  MHC class II binding epitope
HITVYMKDVKVSL

SEQ ID NO: 1678 - protein, 13 aa, Artificial Sequence
  MHC class II binding epitope
ITVYMKDVKVSLF

SEQ ID NO: 1679 - protein, 13 aa, Artificial Sequence
  MHC class II binding epitope
TVYMKDVKVSLFK

SEQ ID NO: 1680 - protein, 13 aa, Artificial Sequence
  MHC class II binding epitope
VYMKDVKVSLFKK

SEQ ID NO: 1681 - protein, 13 aa, Artificial Sequence
  MHC class II binding epitope
KDVKVSLFKKDKA

SEQ ID NO: 1682 - protein, 13 aa, Artificial Sequence
  MHC class II binding epitope
VKVSLFKKDKAML

SEQ ID NO: 1683 - protein, 13 aa, Artificial Sequence
  MHC class II binding epitope
VSLFKKDKAMLFT

SEQ ID NO: 1684 - protein, 13 aa, Artificial Sequence
  MHC class II binding epitope
SLFKKDKAMLFTY

SEQ ID NO: 1685 - protein, 13 aa, Artificial Sequence
  MHC class II binding epitope
FKKDKAMLFTYDQ

SEQ ID NO: 1686 - protein, 13 aa, Artificial Sequence
  MHC class II binding epitope
KDKAMLFTYDQYQ

SEQ ID NO: 1687 - protein, 13 aa, Artificial Sequence
  MHC class II binding epitope
KAMLFTYDQYQEN

SEQ ID NO: 1688 - protein, 13 aa, Artificial Sequence
  MHC class II binding epitope
AMLFTYDQYQENN

SEQ ID NO: 1689 - protein, 13 aa, Artificial Sequence
  MHC class II binding epitope
MLFTYDQYQENNV

SEQ ID NO: 1690 - protein, 13 aa, Artificial Sequence
  MHC class II binding epitope
FTYDQYQENNVDQ

SEQ ID NO: 1691 - protein, 13 aa, Artificial Sequence
  MHC class II binding epitope
YDQYQENNVDQAS

SEQ ID NO: 1692 - protein, 13 aa, Artificial Sequence
  MHC class II binding epitope
DQYQENNVDQASG

SEQ ID NO: 1693 - protein, 13 aa, Artificial Sequence
  MHC class II binding epitope
ENNVDQASGSVLL

SEQ ID NO: 1694 - protein, 13 aa, Artificial Sequence
  MHC class II binding epitope
NNVDQASGSVLLH

SEQ ID NO: 1695 - protein, 13 aa, Artificial Sequence
  MHC class II binding epitope
ASGSVLLHLEVGD

SEQ ID NO: 1696 - protein, 13 aa, Artificial Sequence
  MHC class II binding epitope
GSVLLHLEVGDQV

SEQ ID NO: 1697 - protein, 13 aa, Artificial Sequence
  MHC class II binding epitope
SVLLHLEVGDQVW

SEQ ID NO: 1698 - protein, 13 aa, Artificial Sequence
  MHC class II binding epitope
VLLHLEVGDQVWL

SEQ ID NO: 1699 - protein, 13 aa, Artificial Sequence
  MHC class II binding epitope
LHLEVGDQVWLQV

SEQ ID NO: 1700 - protein, 13 aa, Artificial Sequence
  MHC class II binding epitope
LEVGDQVWLQVYG

SEQ ID NO: 1701 - protein, 13 aa, Artificial Sequence
  MHC class II binding epitope
DQVWLQVYGEGER

SEQ ID NO: 1702 - protein, 13 aa, Artificial Sequence
  MHC class II binding epitope
QVWLQVYGEGERN

SEQ ID NO: 1703 - protein, 13 aa, Artificial Sequence
  MHC class II binding epitope
VWLQVYGEGERNG

SEQ ID NO: 1704 - protein, 13 aa, Artificial Sequence
  MHC class II binding epitope
LQVYGEGERNGLY

SEQ ID NO: 1705 - protein, 13 aa, Artificial Sequence
  MHC class II binding epitope
QVYGEGERNGLYA

SEQ ID NO: 1706 - protein, 13 aa, Artificial Sequence
  MHC class II binding epitope
NGLYADNDNDSTF

SEQ ID NO: 1707 - protein, 13 aa, Artificial Sequence
  MHC class II binding epitope
GLYADNDNDSTFT

SEQ ID NO: 1708 - protein, 13 aa, Artificial Sequence
  MHC class II binding epitope
LYADNDNDSTFTG

SEQ ID NO: 1709 - protein, 13 aa, Artificial Sequence
  MHC class II binding epitope
DNDSTFTGFLLYH

SEQ ID NO: 1710 - protein, 13 aa, Artificial Sequence
  MHC class II binding epitope
STFTGFLLYHDTN

SEQ ID NO: 1711 - protein, 13 aa, Artificial Sequence
  MHC class II binding epitope
VQLQQSGAELMKP

SEQ ID NO: 1712 - protein, 13 aa, Artificial Sequence
  MHC class II binding epitope
QSGAELMKPGASV

SEQ ID NO: 1713 - protein, 13 aa, Artificial Sequence
  MHC class II binding epitope
AELMKPGASVKMS

SEQ ID NO: 1714 - protein, 13 aa, Artificial Sequence
  MHC class II binding epitope
ELMKPGASVKMSC

SEQ ID NO: 1715 - protein, 13 aa, Artificial Sequence
  MHC class II binding epitope
ASVKMSCKATGYI

SEQ ID NO: 1716 - protein, 13 aa, Artificial Sequence
  MHC class II binding epitope
VKMSCKATGYIFS

SEQ ID NO: 1717 - protein, 13 aa, Artificial Sequence
  MHC class II binding epitope
KMSCKATGYIFSN

SEQ ID NO: 1718 - protein, 13 aa, Artificial Sequence
  MHC class II binding epitope
ATGYIFSNYWIQW

SEQ ID NO: 1719 - protein, 13 aa, Artificial Sequence
  MHC class II binding epitope
TGYIFSNYWIQWI

SEQ ID NO: 1720 - protein, 13 aa, Artificial Sequence
  MHC class II binding epitope
GYIFSNYWIQWIK

SEQ ID NO: 1721 - protein, 13 aa, Artificial Sequence
  MHC class II binding epitope
YIFSNYWIQWIKQ

SEQ ID NO: 1722 - protein, 13 aa, Artificial Sequence
  MHC class II binding epitope
SNYWIQWIKQRPG

SEQ ID NO: 1723 - protein, 13 aa, Artificial Sequence
  MHC class II binding epitope
NYWIQWIKQRPGH

SEQ ID NO: 1724 - protein, 13 aa, Artificial Sequence
  MHC class II binding epitope
YWIQWIKQRPGHG

SEQ ID NO: 1725 - protein, 13 aa, Artificial Sequence
  MHC class II binding epitope
IQWIKQRPGHGLE

SEQ ID NO: 1726 - protein, 13 aa, Artificial Sequence
  MHC class II binding epitope
QWIKQRPGHGLEW

SEQ ID NO: 1727 - protein, 13 aa, Artificial Sequence
  MHC class II binding epitope
HGLEWIGEILPGS

SEQ ID NO: 1728 - protein, 13 aa, Artificial Sequence
  MHC class II binding epitope
LEWIGEILPGSGS

SEQ ID NO: 1729 - protein, 13 aa, Artificial Sequence
  MHC class II binding epitope
EWIGEILPGSGST

SEQ ID NO: 1730 - protein, 13 aa, Artificial Sequence
  MHC class II binding epitope
WIGEILPGSGSTE

SEQ ID NO: 1731 - protein, 13 aa, Artificial Sequence
  MHC class II binding epitope
GEILPGSGSTEYT

SEQ ID NO: 1732 - protein, 13 aa, Artificial Sequence
  MHC class II binding epitope
EILPGSGSTEYTE

SEQ ID NO: 1733 - protein, 13 aa, Artificial Sequence
  MHC class II binding epitope
TEYTENFKDKAAF

SEQ ID NO: 1734 - protein, 13 aa, Artificial Sequence
  MHC class II binding epitope
ENFKDKAAFTADT

SEQ ID NO: 1735 - protein, 13 aa, Artificial Sequence
  MHC class II binding epitope
FKDKAAFTADTSS

SEQ ID NO: 1736 - protein, 13 aa, Artificial Sequence
  MHC class II binding epitope
KAAFTADTSSNTA

SEQ ID NO: 1737 - protein, 13 aa, Artificial Sequence
  MHC class II binding epitope
AAFTADTSSNTAY

SEQ ID NO: 1738 - protein, 13 aa, Artificial Sequence
  MHC class II binding epitope
TAYMQLSSLTSED

SEQ ID NO: 1739 - protein, 13 aa, Artificial Sequence
  MHC class II binding epitope
AYMQLSSLTSEDS

SEQ ID NO: 1740 - protein, 13 aa, Artificial Sequence
  MHC class II binding epitope
MQLSSLTSEDSAV

SEQ ID NO: 1741 - protein, 13 aa, Artificial Sequence
  MHC class II binding epitope
SSLTSEDSAVYYC

SEQ ID NO: 1742 - protein, 13 aa, Artificial Sequence
  MHC class II binding epitope
SLTSEDSAVYYCA

SEQ ID NO: 1743 - protein, 13 aa, Artificial Sequence
  MHC class II binding epitope
TSEDSAVYYCARY

SEQ ID NO: 1744 - protein, 13 aa, Artificial Sequence
  MHC class II binding epitope
SAVYYCARYFFGS

SEQ ID NO: 1745 - protein, 13 aa, Artificial Sequence
  MHC class II binding epitope
AVYYCARYFFGSS

SEQ ID NO: 1746 - protein, 13 aa, Artificial Sequence
  MHC class II binding epitope
VYYCARYFFGSSP

SEQ ID NO: 1747 - protein, 13 aa, Artificial Sequence
  MHC class II binding epitope
CARYFFGSSPNWY

SEQ ID NO: 1748 - protein, 13 aa, Artificial Sequence
  MHC class II binding epitope
ARYFFGSSPNWYF

SEQ ID NO: 1749 - protein, 13 aa, Artificial Sequence
  MHC class II binding epitope
RYFFGSSPNWYFD

SEQ ID NO: 1750 - protein, 13 aa, Artificial Sequence
  MHC class II binding epitope
YFFGSSPNWYFDV

SEQ ID NO: 1751 - protein, 13 aa, Artificial Sequence
  MHC class II binding epitope
PNWYFDVWGAGTT

SEQ ID NO: 1752 - protein, 13 aa, Artificial Sequence
  MHC class II binding epitope
NWYFDVWGAGTTV

SEQ ID NO: 1753 - protein, 13 aa, Artificial Sequence
  MHC class II binding epitope
WYFDVWGAGTTVT

SEQ ID NO: 1754 - protein, 13 aa, Artificial Sequence
  MHC class II binding epitope
FDVWGAGTTVTVS

SEQ ID NO: 1755 - protein, 13 aa, Artificial Sequence
  MHC class II binding epitope
DVWGAGTTVTVSS

SEQ ID NO: 1756 - protein, 13 aa, Artificial Sequence
  MHC class II binding epitope
IQMTQSPASLSAS

SEQ ID NO: 1757 - protein, 13 aa, Artificial Sequence
  MHC class II binding epitope
ASLSASVGETVTI

SEQ ID NO: 1758 - protein, 13 aa, Artificial Sequence
  MHC class II binding epitope
ASVGETVTITCGA

SEQ ID NO: 1759 - protein, 13 aa, Artificial Sequence
  MHC class II binding epitope
ETVTITCGASENI

SEQ ID NO: 1760 - protein, 13 aa, Artificial Sequence
  MHC class II binding epitope
VTITCGASENIYG

SEQ ID NO: 1761 - protein, 13 aa, Artificial Sequence
  MHC class II binding epitope
TITCGASENIYGA

SEQ ID NO: 1762 - protein, 13 aa, Artificial Sequence
  MHC class II binding epitope
ENIYGALNWYQRK

SEQ ID NO: 1763 - protein, 13 aa, Artificial Sequence
  MHC class II binding epitope
NIYGALNWYQRKQ

SEQ ID NO: 1764 - protein, 13 aa, Artificial Sequence
  MHC class II binding epitope
GALNWYQRKQGKS

SEQ ID NO: 1765 - protein, 13 aa, Artificial Sequence
  MHC class II binding epitope
LNWYQRKQGKSPQ

SEQ ID NO: 1766 - protein, 13 aa, Artificial Sequence
  MHC class II binding epitope
NWYQRKQGKSPQL

SEQ ID NO: 1767 - protein, 13 aa, Artificial Sequence
  MHC class II binding epitope
GKSPQLLIYGATN

SEQ ID NO: 1768 - protein, 13 aa, Artificial Sequence
  MHC class II binding epitope
PQLLIYGATNLAD

SEQ ID NO: 1769 - protein, 13 aa, Artificial Sequence
  MHC class II binding epitope
QLLIYGATNLADG

SEQ ID NO: 1770 - protein, 13 aa, Artificial Sequence
  MHC class II binding epitope
LLIYGATNLADGM

SEQ ID NO: 1771 - protein, 13 aa, Artificial Sequence
  MHC class II binding epitope
LIYGATNLADGMS

SEQ ID NO: 1772 - protein, 13 aa, Artificial Sequence
  MHC class II binding epitope
TNLADGMSSRFSG

SEQ ID NO: 1773 - protein, 13 aa, Artificial Sequence
  MHC class II binding epitope
DGMSSRFSGSGSG

SEQ ID NO: 1774 - protein, 13 aa, Artificial Sequence
  MHC class II binding epitope
SRFSGSGSGRQYY

SEQ ID NO: 1775 - protein, 13 aa, Artificial Sequence
  MHC class II binding epitope
SGSGRQYYLKISS

SEQ ID NO: 1776 - protein, 13 aa, Artificial Sequence
  MHC class II binding epitope
RQYYLKISSLHPD

SEQ ID NO: 1777 - protein, 13 aa, Artificial Sequence
  MHC class II binding epitope
QYYLKISSLHPDD

SEQ ID NO: 1778 - protein, 13 aa, Artificial Sequence
  MHC class II binding epitope
YYLKISSLHPDDV

SEQ ID NO: 1779 - protein, 13 aa, Artificial Sequence
  MHC class II binding epitope
LKISSLHPDDVAT

SEQ ID NO: 1780 - protein, 13 aa, Artificial Sequence
  MHC class II binding epitope
SSLHPDDVATYYC

SEQ ID NO: 1781 - protein, 13 aa, Artificial Sequence
  MHC class II binding epitope
SLHPDDVATYYCQ

SEQ ID NO: 1782 - protein, 13 aa, Artificial Sequence
  MHC class II binding epitope
DDVATYYCQNVLN

SEQ ID NO: 1783 - protein, 13 aa, Artificial Sequence
  MHC class II binding epitope
ATYYCQNVLNTPL

SEQ ID NO: 1784 - protein, 13 aa, Artificial Sequence
  MHC class II binding epitope
TYYCQNVLNTPLT

SEQ ID NO: 1785 - protein, 13 aa, Artificial Sequence
  MHC class II binding epitope
YYCQNVLNTPLTF

SEQ ID NO: 1786 - protein, 13 aa, Artificial Sequence
  MHC class II binding epitope
YCQNVLNTPLTFG

SEQ ID NO: 1787 - protein, 13 aa, Artificial Sequence
  MHC class II binding epitope
CQNVLNTPLTFGA

SEQ ID NO: 1788 - protein, 13 aa, Artificial Sequence
  MHC class II binding epitope
QNVLNTPLTFGAG

SEQ ID NO: 1789 - protein, 13 aa, Artificial Sequence
  MHC class II binding epitope
NVLNTPLTFGAGT

SEQ ID NO: 1790 - protein, 13 aa, Artificial Sequence
  MHC class II binding epitope
TPLTFGAGTKLEL

SEQ ID NO: 1791 - protein, 13 aa, Artificial Sequence
  MHC class II binding epitope
VQLQQPGAELVKA

SEQ ID NO: 1792 - protein, 13 aa, Artificial Sequence
  MHC class II binding epitope
LQQPGAELVKAGA

SEQ ID NO: 1793 - protein, 13 aa, Artificial Sequence
  MHC class II binding epitope
AELVKAGASVKMS

SEQ ID NO: 1794 - protein, 13 aa, Artificial Sequence
  MHC class II binding epitope
ELVKAGASVKMSC

SEQ ID NO: 1795 - protein, 13 aa, Artificial Sequence
  MHC class II binding epitope
ASVKMSCKASGYT

SEQ ID NO: 1796 - protein, 13 aa, Artificial Sequence
  MHC class II binding epitope
VKMSCKASGYTFT

SEQ ID NO: 1797 - protein, 13 aa, Artificial Sequence
  MHC class II binding epitope
KMSCKASGYTFTS

SEQ ID NO: 1798 - protein, 13 aa, Artificial Sequence
  MHC class II binding epitope
ASGYTFTSYNMHW

SEQ ID NO: 1799 - protein, 13 aa, Artificial Sequence
  MHC class II binding epitope
SGYTFTSYNMHWV

SEQ ID NO: 1800 - protein, 13 aa, Artificial Sequence
  MHC class II binding epitope
YTFTSYNMHWVKQ

SEQ ID NO: 1801 - protein, 13 aa, Artificial Sequence
  MHC class II binding epitope
TSYNMHWVKQTPG

SEQ ID NO: 1802 - protein, 13 aa, Artificial Sequence
  MHC class II binding epitope
YNMHWVKQTPGRG

SEQ ID NO: 1803 - protein, 13 aa, Artificial Sequence
  MHC class II binding epitope
MHWVKQTPGRGLE

SEQ ID NO: 1804 - protein, 13 aa, Artificial Sequence
  MHC class II binding epitope
HWVKQTPGRGLEW

SEQ ID NO: 1805 - protein, 13 aa, Artificial Sequence
  MHC class II binding epitope
TPGRGLEWIGAIY

SEQ ID NO: 1806 - protein, 13 aa, Artificial Sequence
  MHC class II binding epitope
RGLEWIGAIYPGN

SEQ ID NO: 1807 - protein, 13 aa, Artificial Sequence
  MHC class II binding epitope
GLEWIGAIYPGNG

SEQ ID NO: 1808 - protein, 13 aa, Artificial Sequence
  MHC class II binding epitope
EWIGAIYPGNGDT

SEQ ID NO: 1809 - protein, 13 aa, Artificial Sequence
  MHC class II binding epitope
GAIYPGNGDTSYN

SEQ ID NO: 1810 - protein, 13 aa, Artificial Sequence
  MHC class II binding epitope
AIYPGNGDTSYNQ

SEQ ID NO: 1811 - protein, 13 aa, Artificial Sequence
  MHC class II binding epitope
YPGNGDTSYNQKF

SEQ ID NO: 1812 - protein, 13 aa, Artificial Sequence
  MHC class II binding epitope
TSYNQKFKGKATL

SEQ ID NO: 1813 - protein, 13 aa, Artificial Sequence
  MHC class II binding epitope
YNQKFKGKATLTA

SEQ ID NO: 1814 - protein, 13 aa, Artificial Sequence
  MHC class II binding epitope
QKFKGKATLTADK

SEQ ID NO: 1815 - protein, 13 aa, Artificial Sequence
  MHC class II binding epitope
ATLTADKSSSTAY

SEQ ID NO: 1816 - protein, 13 aa, Artificial Sequence
  MHC class II binding epitope
TAYMQLSSLTSED

SEQ ID NO: 1817 - protein, 13 aa, Artificial Sequence
  MHC class II binding epitope
AYMQLSSLTSEDS

SEQ ID NO: 1818 - protein, 13 aa, Artificial Sequence
  MHC class II binding epitope
MQLSSLTSEDSAV

SEQ ID NO: 1819 - protein, 13 aa, Artificial Sequence
  MHC class II binding epitope
SSLTSEDSAVYYC

SEQ ID NO: 1820 - protein, 13 aa, Artificial Sequence
  MHC class II binding epitope
SLTSEDSAVYYCA

SEQ ID NO: 1821 - protein, 13 aa, Artificial Sequence
  MHC class II binding epitope
TSEDSAVYYCARS

SEQ ID NO: 1822 - protein, 13 aa, Artificial Sequence
  MHC class II binding epitope
SAVYYCARSTYYG

SEQ ID NO: 1823 - protein, 13 aa, Artificial Sequence
  MHC class II binding epitope
AVYYCARSTYYGG

SEQ ID NO: 1824 - protein, 13 aa, Artificial Sequence
  MHC class II binding epitope
VYYCARSTYYGGD

SEQ ID NO: 1825 - protein, 13 aa, Artificial Sequence
  MHC class II binding epitope
STYYGGDTYFNVW

SEQ ID NO: 1826 - protein, 13 aa, Artificial Sequence
  MHC class II binding epitope
TYYGGDTYFNVWG

SEQ ID NO: 1827 - protein, 13 aa, Artificial Sequence
  MHC class II binding epitope
DTYFNVWGAGTTV

SEQ ID NO: 1828 - protein, 13 aa, Artificial Sequence
  MHC class II binding epitope
TYFNVWGAGTTVT

SEQ ID NO: 1829 - protein, 13 aa, Artificial Sequence
  MHC class II binding epitope
FNVWGAGTTVTVS

SEQ ID NO: 1830 - protein, 13 aa, Artificial Sequence
  MHC class II binding epitope
NVWGAGTTVTVSA

SEQ ID NO: 1831 - protein, 13 aa, Artificial Sequence
  MHC class II binding epitope
QIVLSQSPAILSA

SEQ ID NO: 1832 - protein, 13 aa, Artificial Sequence
  MHC class II binding epitope
IVLSQSPAILSAS

SEQ ID NO: 1833 - protein, 13 aa, Artificial Sequence
  MHC class II binding epitope
QSPAILSASPGEK

SEQ ID NO: 1834 - protein, 13 aa, Artificial Sequence
  MHC class II binding epitope
PAILSASPGEKVT

SEQ ID NO: 1835 - protein, 13 aa, Artificial Sequence
  MHC class II binding epitope
AILSASPGEKVTM

SEQ ID NO: 1836 - protein, 13 aa, Artificial Sequence
  MHC class II binding epitope
EKVTMTCRASSSV

SEQ ID NO: 1837 - protein, 13 aa, Artificial Sequence
  MHC class II binding epitope
VTMTCRASSSVSY

SEQ ID NO: 1838 - protein, 13 aa, Artificial Sequence
  MHC class II binding epitope
TMTCRASSSVSYI

SEQ ID NO: 1839 - protein, 13 aa, Artificial Sequence
  MHC class II binding epitope
SSVSYIHWFQQKP

SEQ ID NO: 1840 - protein, 13 aa, Artificial Sequence
  MHC class II binding epitope
VSYIHWFQQKPGS

SEQ ID NO: 1841 - protein, 13 aa, Artificial Sequence
  MHC class II binding epitope
SYIHWFQQKPGSS

SEQ ID NO: 1842 - protein, 13 aa, Artificial Sequence
  MHC class II binding epitope
IHWFQQKPGSSPK

SEQ ID NO: 1843 - protein, 13 aa, Artificial Sequence
  MHC class II binding epitope
KPWIYATSNLASG

SEQ ID NO: 1844 - protein, 13 aa, Artificial Sequence
  MHC class II binding epitope
PWIYATSNLASGV

SEQ ID NO: 1845 - protein, 13 aa, Artificial Sequence
  MHC class II binding epitope
WIYATSNLASGVP

SEQ ID NO: 1846 - protein, 13 aa, Artificial Sequence
  MHC class II binding epitope
ATSNLASGVPVRF

SEQ ID NO: 1847 - protein, 13 aa, Artificial Sequence
  MHC class II binding epitope
SNLASGVPVRFSG

SEQ ID NO: 1848 - protein, 13 aa, Artificial Sequence
  MHC class II binding epitope
SGVPVRFSGSGSG

SEQ ID NO: 1849 - protein, 13 aa, Artificial Sequence
  MHC class II binding epitope
VPVRFSGSGSGTS

SEQ ID NO: 1850 - protein, 13 aa, Artificial Sequence
  MHC class II binding epitope
VRFSGSGSGTSYS

SEQ ID NO: 1851 - protein, 13 aa, Artificial Sequence
  MHC class II binding epitope
GTSYSLTISRVEA

SEQ ID NO: 1852 - protein, 13 aa, Artificial Sequence
  MHC class II binding epitope
TSYSLTISRVEAE

SEQ ID NO: 1853 - protein, 13 aa, Artificial Sequence
  MHC class II binding epitope
SYSLTISRVEAED

SEQ ID NO: 1854 - protein, 13 aa, Artificial Sequence
  MHC class II binding epitope
YSLTISRVEAEDA

SEQ ID NO: 1855 - protein, 13 aa, Artificial Sequence
  MHC class II binding epitope
LTISRVEAEDAAT

SEQ ID NO: 1856 - protein, 13 aa, Artificial Sequence
  MHC class II binding epitope
SRVEAEDAATYYC

SEQ ID NO: 1857 - protein, 13 aa, Artificial Sequence
  MHC class II binding epitope
RVEAEDAATYYCQ

SEQ ID NO: 1858 - protein, 13 aa, Artificial Sequence
  MHC class II binding epitope
ATYYCQQWTSNPP

SEQ ID NO: 1859 - protein, 13 aa, Artificial Sequence
  MHC class II binding epitope
TYYCQQWTSNPPT

SEQ ID NO: 1860 - protein, 13 aa, Artificial Sequence
  MHC class II binding epitope
QQWTSNPPTFGGG

SEQ ID NO: 1861 - protein, 13 aa, Artificial Sequence
  MHC class II binding epitope
NPPTFGGGTKLEI

SEQ ID NO: 1862 - protein, 13 aa, Artificial Sequence
  MHC class II binding epitope
VQLQQSGAELAKP

SEQ ID NO: 1863 - protein, 13 aa, Artificial Sequence
  MHC class II binding epitope
AELAKPGASVKMS

SEQ ID NO: 1864 - protein, 13 aa, Artificial Sequence
  MHC class II binding epitope
ASVKMSCKASGYT

SEQ ID NO: 1865 - protein, 13 aa, Artificial Sequence
  MHC class II binding epitope
VKMSCKASGYTFT

SEQ ID NO: 1866 - protein, 13 aa, Artificial Sequence
  MHC class II binding epitope
KMSCKASGYTFTS

SEQ ID NO: 1867 - protein, 13 aa, Artificial Sequence
  MHC class II binding epitope
ASGYTFTSYRMHW

SEQ ID NO: 1868 - protein, 13 aa, Artificial Sequence
  MHC class II binding epitope
SGYTFTSYRMHWV

SEQ ID NO: 1869 - protein, 13 aa, Artificial Sequence
  MHC class II binding epitope
YTFTSYRMHWVKQ

SEQ ID NO: 1870 - protein, 13 aa, Artificial Sequence
  MHC class II binding epitope
TSYRMHWVKQRPG

SEQ ID NO: 1871 - protein, 13 aa, Artificial Sequence
  MHC class II binding epitope
YRMHWVKQRPGQG

SEQ ID NO: 1872 - protein, 13 aa, Artificial Sequence
  MHC class II binding epitope
MHWVKQRPGQGLE

SEQ ID NO: 1873 - protein, 13 aa, Artificial Sequence
  MHC class II binding epitope
HWVKQRPGQGLEW

SEQ ID NO: 1874 - protein, 13 aa, Artificial Sequence
  MHC class II binding epitope
RPGQGLEWIGYIN

SEQ ID NO: 1875 - protein, 13 aa, Artificial Sequence
  MHC class II binding epitope
QGLEWIGYINPST

SEQ ID NO: 1876 - protein, 13 aa, Artificial Sequence
  MHC class II binding epitope
LEWIGYINPSTGY

SEQ ID NO: 1877 - protein, 13 aa, Artificial Sequence
  MHC class II binding epitope
EWIGYINPSTGYT

SEQ ID NO: 1878 - protein, 13 aa, Artificial Sequence
  MHC class II binding epitope
IGYINPSTGYTEY

SEQ ID NO: 1879 - protein, 13 aa, Artificial Sequence
  MHC class II binding epitope
GYINPSTGYTEYN

SEQ ID NO: 1880 - protein, 13 aa, Artificial Sequence
  MHC class II binding epitope
TGYTEYNQKFKDK

SEQ ID NO: 1881 - protein, 13 aa, Artificial Sequence
  MHC class II binding epitope
TEYNQKFKDKATL

SEQ ID NO: 1882 - protein, 13 aa, Artificial Sequence
  MHC class II binding epitope
QKFKDKATLTADK

SEQ ID NO: 1883 - protein, 13 aa, Artificial Sequence
  MHC class II binding epitope
ATLTADKSSSTAY

SEQ ID NO: 1884 - protein, 13 aa, Artificial Sequence
  MHC class II binding epitope
TAYMQLSSLTFED

SEQ ID NO: 1885 - protein, 13 aa, Artificial Sequence
  MHC class II binding epitope
AYMQLSSLTFEDS

SEQ ID NO: 1886 - protein, 13 aa, Artificial Sequence
  MHC class II binding epitope
YMQLSSLTFEDSA

SEQ ID NO: 1887 - protein, 13 aa, Artificial Sequence
  MHC class II binding epitope
MQLSSLTFEDSAV

SEQ ID NO: 1888 - protein, 13 aa, Artificial Sequence
  MHC class II binding epitope
SSLTFEDSAVYYC

SEQ ID NO: 1889 - protein, 13 aa, Artificial Sequence
  MHC class II binding epitope
SLTFEDSAVYYCA

SEQ ID NO: 1890 - protein, 13 aa, Artificial Sequence
  MHC class II binding epitope
LTFEDSAVYYCAR

SEQ ID NO: 1891 - protein, 13 aa, Artificial Sequence
  MHC class II binding epitope
SAVYYCARGGGVF

SEQ ID NO: 1892 - protein, 13 aa, Artificial Sequence
  MHC class II binding epitope
AVYYCARGGGVFD

SEQ ID NO: 1893 - protein, 13 aa, Artificial Sequence
  MHC class II binding epitope
VYYCARGGGVFDY

SEQ ID NO: 1894 - protein, 13 aa, Artificial Sequence
  MHC class II binding epitope
GGVFDYWGQGTTL

SEQ ID NO: 1895 - protein, 13 aa, Artificial Sequence
  MHC class II binding epitope
GVFDYWGQGTTLT

SEQ ID NO: 1896 - protein, 13 aa, Artificial Sequence
  MHC class II binding epitope
FDYWGQGTTLTVS

SEQ ID NO: 1897 - protein, 13 aa, Artificial Sequence
  MHC class II binding epitope
DYWGQGTTLTVSS

SEQ ID NO: 1898 - protein, 13 aa, Artificial Sequence
  MHC class II binding epitope
QIVLTQSPAIMSA

SEQ ID NO: 1899 - protein, 13 aa, Artificial Sequence
  MHC class II binding epitope
IVLTQSPAIMSAS

SEQ ID NO: 1900 - protein, 13 aa, Artificial Sequence
  MHC class II binding epitope
QSPAIMSASPGEK

SEQ ID NO: 1901 - protein, 13 aa, Artificial Sequence
  MHC class II binding epitope
PAIMSASPGEKVT

SEQ ID NO: 1902 - protein, 13 aa, Artificial Sequence
  MHC class II binding epitope
AIMSASPGEKVTI

SEQ ID NO: 1903 - protein, 13 aa, Artificial Sequence
  MHC class II binding epitope
EKVTITCSASSSI

SEQ ID NO: 1904 - protein, 13 aa, Artificial Sequence
  MHC class II binding epitope
VTITCSASSSISY

SEQ ID NO: 1905 - protein, 13 aa, Artificial Sequence
  MHC class II binding epitope
TITCSASSSISYM

SEQ ID NO: 1906 - protein, 13 aa, Artificial Sequence
  MHC class II binding epitope
SSISYMHWFQQKP

SEQ ID NO: 1907 - protein, 13 aa, Artificial Sequence
  MHC class II binding epitope
ISYMHWFQQKPGT

SEQ ID NO: 1908 - protein, 13 aa, Artificial Sequence
  MHC class II binding epitope
SYMHWFQQKPGTS

SEQ ID NO: 1909 - protein, 13 aa, Artificial Sequence
  MHC class II binding epitope
MHWFQQKPGTSPK

SEQ ID NO: 1910 - protein, 13 aa, Artificial Sequence
  MHC class II binding epitope
HWFQQKPGTSPKL

SEQ ID NO: 1911 - protein, 13 aa, Artificial Sequence
  MHC class II binding epitope
SPKLWIYTTSNLA

SEQ ID NO: 1912 - protein, 13 aa, Artificial Sequence
  MHC class II binding epitope
PKLWIYTTSNLAS

SEQ ID NO: 1913 - protein, 13 aa, Artificial Sequence
  MHC class II binding epitope
KLWIYTTSNLASG

SEQ ID NO: 1914 - protein, 13 aa, Artificial Sequence
  MHC class II binding epitope
LWIYTTSNLASGV

SEQ ID NO: 1915 - protein, 13 aa, Artificial Sequence
  MHC class II binding epitope
WIYTTSNLASGVP

SEQ ID NO: 1916 - protein, 13 aa, Artificial Sequence
  MHC class II binding epitope
TTSNLASGVPARF

SEQ ID NO: 1917 - protein, 13 aa, Artificial Sequence
  MHC class II binding epitope
SNLASGVPARFSG

SEQ ID NO: 1918 - protein, 13 aa, Artificial Sequence
  MHC class II binding epitope
SGVPARFSGSGSG

SEQ ID NO: 1919 - protein, 13 aa, Artificial Sequence
  MHC class II binding epitope
ARFSGSGSGTSYS

SEQ ID NO: 1920 - protein, 13 aa, Artificial Sequence
  MHC class II binding epitope
GTSYSLTISRMEA

SEQ ID NO: 1921 - protein, 13 aa, Artificial Sequence
  MHC class II binding epitope
TSYSLTISRMEAE

SEQ ID NO: 1922 - protein, 13 aa, Artificial Sequence
  MHC class II binding epitope
SYSLTISRMEAED

SEQ ID NO: 1923 - protein, 13 aa, Artificial Sequence
  MHC class II binding epitope
YSLTISRMEAEDA

SEQ ID NO: 1924 - protein, 13 aa, Artificial Sequence
  MHC class II binding epitope
LTISRMEAEDAAT

SEQ ID NO: 1925 - protein, 13 aa, Artificial Sequence
  MHC class II binding epitope
SRMEAEDAATYYC

SEQ ID NO: 1926 - protein, 13 aa, Artificial Sequence
  MHC class II binding epitope
ATYYCHQRSTYPL

SEQ ID NO: 1927 - protein, 13 aa, Artificial Sequence
  MHC class II binding epitope
TYYCHQRSTYPLT

SEQ ID NO: 1928 - protein, 13 aa, Artificial Sequence
  MHC class II binding epitope
STYPLTFGSGTKL

SEQ ID NO: 1929 - protein, 13 aa, Artificial Sequence
  MHC class II binding epitope
TYPLTFGSGTKLE

SEQ ID NO: 1930 - protein, 13 aa, Artificial Sequence
  MHC class II binding epitope
YPLTFGSGTKLEL

SEQ ID NO: 1931 - protein, 13 aa, Artificial Sequence
  MHC class II binding epitope
VQLVQSGAEVKKP

SEQ ID NO: 1932 - protein, 13 aa, Artificial Sequence
  MHC class II binding epitope
QLVQSGAEVKKPG

SEQ ID NO: 1933 - protein, 13 aa, Artificial Sequence
  MHC class II binding epitope
AEVKKPGSSVKVS

SEQ ID NO: 1934 - protein, 13 aa, Artificial Sequence
  MHC class II binding epitope
SSVKVSCKASGYT

SEQ ID NO: 1935 - protein, 13 aa, Artificial Sequence
  MHC class II binding epitope
VKVSCKASGYTFT

SEQ ID NO: 1936 - protein, 13 aa, Artificial Sequence
  MHC class II binding epitope
KVSCKASGYTFTS

SEQ ID NO: 1937 - protein, 13 aa, Artificial Sequence
  MHC class II binding epitope
ASGYTFTSYRMHW

SEQ ID NO: 1938 - protein, 13 aa, Artificial Sequence
  MHC class II binding epitope
SGYTFTSYRMHWV

SEQ ID NO: 1939 - protein, 13 aa, Artificial Sequence
  MHC class II binding epitope
YTFTSYRMHWVRQ

SEQ ID NO: 1940 - protein, 13 aa, Artificial Sequence
  MHC class II binding epitope
TSYRMHWVRQAPG

SEQ ID NO: 1941 - protein, 13 aa, Artificial Sequence
  MHC class II binding epitope
YRMHWVRQAPGQG

SEQ ID NO: 1942 - protein, 13 aa, Artificial Sequence
  MHC class II binding epitope
MHWVRQAPGQGLE

SEQ ID NO: 1943 - protein, 13 aa, Artificial Sequence
  MHC class II binding epitope
HWVRQAPGQGLEW

SEQ ID NO: 1944 - protein, 13 aa, Artificial Sequence
  MHC class II binding epitope
RQAPGQGLEWIGY

SEQ ID NO: 1945 - protein, 13 aa, Artificial Sequence
  MHC class II binding epitope
APGQGLEWIGYIN

SEQ ID NO: 1946 - protein, 13 aa, Artificial Sequence
  MHC class II binding epitope
QGLEWIGYINPST

SEQ ID NO: 1947 - protein, 13 aa, Artificial Sequence
  MHC class II binding epitope
LEWIGYINPSTGY

SEQ ID NO: 1948 - protein, 13 aa, Artificial Sequence
  MHC class II binding epitope
EWIGYINPSTGYT

SEQ ID NO: 1949 - protein, 13 aa, Artificial Sequence
  MHC class II binding epitope
WIGYINPSTGYTE

SEQ ID NO: 1950 - protein, 13 aa, Artificial Sequence
  MHC class II binding epitope
IGYINPSTGYTEY

SEQ ID NO: 1951 - protein, 13 aa, Artificial Sequence
  MHC class II binding epitope
GYINPSTGYTEYN

SEQ ID NO: 1952 - protein, 13 aa, Artificial Sequence
  MHC class II binding epitope
TGYTEYNQKFKDK

SEQ ID NO: 1953 - protein, 13 aa, Artificial Sequence
  MHC class II binding epitope
TEYNQKFKDKATI

SEQ ID NO: 1954 - protein, 13 aa, Artificial Sequence
  MHC class II binding epitope
QKFKDKATITADE

SEQ ID NO: 1955 - protein, 13 aa, Artificial Sequence
  MHC class II binding epitope
ATITADESTNTAY

SEQ ID NO: 1956 - protein, 13 aa, Artificial Sequence
  MHC class II binding epitope
TITADESTNTAYM

SEQ ID NO: 1957 - protein, 13 aa, Artificial Sequence
  MHC class II binding epitope
TNTAYMELSSLRS

SEQ ID NO: 1958 - protein, 13 aa, Artificial Sequence
  MHC class II binding epitope
TAYMELSSLRSED

SEQ ID NO: 1959 - protein, 13 aa, Artificial Sequence
  MHC class II binding epitope
AYMELSSLRSEDT

SEQ ID NO: 1960 - protein, 13 aa, Artificial Sequence
  MHC class II binding epitope
MELSSLRSEDTAV

SEQ ID NO: 1961 - protein, 13 aa, Artificial Sequence
  MHC class II binding epitope
SSLRSEDTAVYYC

SEQ ID NO: 1962 - protein, 13 aa, Artificial Sequence
  MHC class II binding epitope
SLRSEDTAVYYCA

SEQ ID NO: 1963 - protein, 13 aa, Artificial Sequence
  MHC class II binding epitope
RSEDTAVYYCARG

SEQ ID NO: 1964 - protein, 13 aa, Artificial Sequence
  MHC class II binding epitope
TAVYYCARGGGVF

SEQ ID NO: 1965 - protein, 13 aa, Artificial Sequence
  MHC class II binding epitope
AVYYCARGGGVFD

SEQ ID NO: 1966 - protein, 13 aa, Artificial Sequence
  MHC class II binding epitope
VYYCARGGGVFDY

SEQ ID NO: 1967 - protein, 13 aa, Artificial Sequence
  MHC class II binding epitope
GGVFDYWGQGTLV

SEQ ID NO: 1968 - protein, 13 aa, Artificial Sequence
  MHC class II binding epitope
GVFDYWGQGTLVT

SEQ ID NO: 1969 - protein, 13 aa, Artificial Sequence
  MHC class II binding epitope
FDYWGQGTLVTVS

SEQ ID NO: 1970 - protein, 13 aa, Artificial Sequence
  MHC class II binding epitope
DYWGQGTLVTVSS

SEQ ID NO: 1971 - protein, 13 aa, Artificial Sequence
  MHC class II binding epitope
IQMTQSPSTLSAS

SEQ ID NO: 1972 - protein, 13 aa, Artificial Sequence
  MHC class II binding epitope
STLSASVGDRVTI

SEQ ID NO: 1973 - protein, 13 aa, Artificial Sequence
  MHC class II binding epitope
ASVGDRVTITCSA

SEQ ID NO: 1974 - protein, 13 aa, Artificial Sequence
  MHC class II binding epitope
DRVTITCSASSSI

SEQ ID NO: 1975 - protein, 13 aa, Artificial Sequence
  MHC class II binding epitope
VTITCSASSSISY

SEQ ID NO: 1976 - protein, 13 aa, Artificial Sequence
  MHC class II binding epitope
TITCSASSSISYM

SEQ ID NO: 1977 - protein, 13 aa, Artificial Sequence
  MHC class II binding epitope
SSISYMHWYQQKP

SEQ ID NO: 1978 - protein, 13 aa, Artificial Sequence
  MHC class II binding epitope
ISYMHWYQQKPGK

SEQ ID NO: 1979 - protein, 13 aa, Artificial Sequence
  MHC class II binding epitope
SYMHWYQQKPGKA

SEQ ID NO: 1980 - protein, 13 aa, Artificial Sequence
  MHC class II binding epitope
MHWYQQKPGKAPK

SEQ ID NO: 1981 - protein, 13 aa, Artificial Sequence
  MHC class II binding epitope
HWYQQKPGKAPKL

SEQ ID NO: 1982 - protein, 13 aa, Artificial Sequence
  MHC class II binding epitope
QKPGKAPKLLIYT

SEQ ID NO: 1983 - protein, 13 aa, Artificial Sequence
  MHC class II binding epitope
PKLLIYTTSNLAS

SEQ ID NO: 1984 - protein, 13 aa, Artificial Sequence
  MHC class II binding epitope
KLLIYTTSNLASG

SEQ ID NO: 1985 - protein, 13 aa, Artificial Sequence
  MHC class II binding epitope
LLIYTTSNLASGV

SEQ ID NO: 1986 - protein, 13 aa, Artificial Sequence
  MHC class II binding epitope
LIYTTSNLASGVP

SEQ ID NO: 1987 - protein, 13 aa, Artificial Sequence
  MHC class II binding epitope
TTSNLASGVPARF

SEQ ID NO: 1988 - protein, 13 aa, Artificial Sequence
  MHC class II binding epitope
SNLASGVPARFSG

SEQ ID NO: 1989 - protein, 13 aa, Artificial Sequence
  MHC class II binding epitope
SGVPARFSGSGSG

SEQ ID NO: 1990 - protein, 13 aa, Artificial Sequence
  MHC class II binding epitope
ARFSGSGSGTEFT

SEQ ID NO: 1991 - protein, 13 aa, Artificial Sequence
  MHC class II binding epitope
SGSGTEFTLTISS

SEQ ID NO: 1992 - protein, 13 aa, Artificial Sequence
  MHC class II binding epitope
GTEFTLTISSLQP

SEQ ID NO: 1993 - protein, 13 aa, Artificial Sequence
  MHC class II binding epitope
TEFTLTISSLQPD

SEQ ID NO: 1994 - protein, 13 aa, Artificial Sequence
  MHC class II binding epitope
FTLTISSLQPDDF

SEQ ID NO: 1995 - protein, 13 aa, Artificial Sequence
  MHC class II binding epitope
LTISSLQPDDFAT

SEQ ID NO: 1996 - protein, 13 aa, Artificial Sequence
  MHC class II binding epitope
TISSLQPDDFATY

SEQ ID NO: 1997 - protein, 13 aa, Artificial Sequence
  MHC class II binding epitope
SSLQPDDFATYYC

SEQ ID NO: 1998 - protein, 13 aa, Artificial Sequence
  MHC class II binding epitope
SLQPDDFATYYCH

SEQ ID NO: 1999 - protein, 13 aa, Artificial Sequence
  MHC class II binding epitope
DDFATYYCHQRST

SEQ ID NO: 2000 - protein, 13 aa, Artificial Sequence
  MHC class II binding epitope
ATYYCHQRSTYPL

SEQ ID NO: 2001 - protein, 13 aa, Artificial Sequence
  MHC class II binding epitope
TYYCHQRSTYPLT

SEQ ID NO: 2002 - protein, 13 aa, Artificial Sequence
  MHC class II binding epitope
STYPLTFGQGTKV

SEQ ID NO: 2003 - protein, 13 aa, Artificial Sequence
  MHC class II binding epitope
TYPLTFGQGTKVE

SEQ ID NO: 2004 - protein, 13 aa, Artificial Sequence
  MHC class II binding epitope
YPLTFGQGTKVEV

SEQ ID NO: 2005 - protein, 113 aa, Artificial Sequence
  MHC class II binding epitope
EVQLLQSGPELKKPGASVKISCKASGSSFTGYNMNWVRQAPGQRLEWIGAIDPYYGGTSYNQKFKGRATLSVDKSSSQAYMHLKSLTSEDSAVYYCVSGMEYWGQGTTVTVSS

SEQ ID NO: 2006 - protein, 113 aa, Artificial Sequence
  MHC class II binding epitope
DVVMTQSPGTLPVSLGERATISCRSSQSLVHRNGNTYLHWYLQKPGQSPKLLIHKVSNRFSGVPDRFSGSGSGTDFTLTISRLEAEDLAVYFCSQSTHVPPLTFGQGTKLEIK

SEQ ID NO: 2007 - protein, 113 aa, Artificial Sequence
  MHC class II binding epitope
EVQLLQSGPELKKPGASVKISCKASGSSFTGYNMNWVRQAIGQRLEWIGLIDPYYGGTSYNQKFKSRVTITADKSSSQAYMHLKSLTSEDTAVYYCVSGMEYWGQGTTVTVSS

SEQ ID NO: 2008 - protein, 113 aa, Artificial Sequence
  MHC class II binding epitope
DVVMTQSPGTLPVSLGERATISCRSSQSLVHSNGNTYLHWYLQKPGQSPKLLIYKVSNRFSGVPDRFSGSGSGTDFTLTISRLEAEDMAVYFCSQSTHVPPPTFGQGTKVEIK

SEQ ID NO: 2009 - protein, 113 aa, Artificial Sequence
  MHC class II binding epitope
EVQLLQSGPELKKPGASVKISCKASGSSFTGYNMNWVRQAPGQRTEWIGAIDPYYGGTSYNQKFKSRVTITADKSSSQAYMHLKSLTSEDTAVYYCVSGMEYWGQGTTVTVSS

SEQ ID NO: 2010 - protein, 113 aa, Artificial Sequence
  MHC class II binding epitope
DVVMTQSPGTLPVSLGERATISCRSSQSLVHSNGNTYLHWYLQKPGQSPKMLIHKVSNRFSGVPDRFSGSGSGTDFTLTISRLEAEDMAVYFCSQSTHVPPPTFGQGTKVEIK

SEQ ID NO: 2011 - protein, 113 aa, Artificial Sequence
  MHC class II binding epitope
EVQLLQSGPELKKPGASVKISCKASGSSFTGYNMNWVRQAPGQRTEWIGAIDPYYGGTSYNQKFKGRVTITADKSSSQAYMHLKSLTSEDTAVYYCVSGMEYWGQGTTVTVSS

SEQ ID NO: 2012 - protein, 113 aa, Artificial Sequence
  MHC class II binding epitope
DVVMTQSPGTLPVSLGERATISCRSSQSLVHSNGNTYLHWYLQKPGQSPKMLIHKVSNRFSGVPDRFSGSGSGTDFTLTISRLEAEDMAVYFCSQSTHVPPTTFGGGTKVEIK

SEQ ID NO: 2013 - protein, 113 aa, Artificial Sequence
  MHC class II binding epitope
EVQLLQSGPELKKPGASVKISCKASGSSFTGYNMNWVRQAPGQRTEWIGAIDPYYGGTSYNQKFKGRVTITVDKSSSQAYMHLKSLTSEDTAVYYCVSGMEYWGQGTTVTVSS

SEQ ID NO: 2014 - protein, 113 aa, Artificial Sequence
  MHC class II binding epitope
DVVMTQSPGTLPVSLGERATISCRSSQSLVHSNGNTYLHWYLQKPGQSPKMLIHKVSNRFSGVPDRFSGSGSGTDFTLTISRLEAEDMAVYFCSQSTHVPPLTFGGGTKVEIK

SEQ ID NO: 2015 - protein, 113 aa, Artificial Sequence
  MHC class II binding epitope
EVQLLQSGPELKKPGASVKISCKASGSSFTGYNMNWVRQAIGQRLEWIGAIDPYYGGTSYNQKFKGRVTITVDKSSSQAYMHLKSLTSEDTAVYYCVSGMEYWGQGTTVTVSS

SEQ ID NO: 2016 - protein, 113 aa, Artificial Sequence
  MHC class II binding epitope
DVVMTQSPGTLPVSLGERATISCRSSQSLVHRNGNTYLHWYLQKPGQSPKMLIHKVSNRFSGVPDRFSGSGSGTDFTLTISRLEAEDMAVYFCSQSTHVPPLTFGGGTKVEIK

SEQ ID NO: 2017 - protein, 113 aa, Artificial Sequence
  MHC class II binding epitope
EVQLVQSGPEVEKPSASVKISCKASGSSFTGYNMNWVRQAIGKSLEWIGAIDPYYGGTSYNQKFKGRATLTVDKSSSTAYMHLKSLTSEDTAVYYCVSGMEYWGQGTTVTVSS

SEQ ID NO: 2018 - protein, 113 aa, Artificial Sequence
  MHC class II binding epitope
DVVMTQTPGSLPVSAGDQASISCRSSQSLVHRNGNTYLHWYLQKPGQSPKLLIHKVSNRFSGVPDRFSGSGSGTDFTLKISRVEAEDSGVYFCSQSTHVPPLTFGAGTKLELK

SEQ ID NO: 2019 - protein, 113 aa, Artificial Sequence
  MHC class II binding epitope
EVQLLQSGPELEKPSASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSS

SEQ ID NO: 2020 - protein, 113 aa, Artificial Sequence
  MHC class II binding epitope
DVVMTQTPLSLPVSLGDQASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELK

SEQ ID NO: 2021 - protein, 116 aa, Artificial Sequence
  MHC class II binding epitope
QIQLVQSGPELKKPGSSVKISCKASGYTFTNYGMNWVKQAPGQGLKWMGWINTYTGEPTYADDFKGRFTFTLETSTSTAYLQLNNLRSEDMATYFCVRFISKGDYWGQGTTVTVSS

SEQ ID NO: 2022 - protein, 106 aa, Artificial Sequence
  MHC class II binding epitope
QILLTQSPASLAVSPGQRATITCSASSSVSYMLWYQQKPGQPPKPWIFDTSNLASGFPARFSGSGSGTSYTLTINSLEAEDAATYYCHQRSGYPYTFGGGTKVEIK

SEQ ID NO: 2023 - protein, 116 aa, Artificial Sequence
  MHC class II binding epitope
QIQLVQSGPELKKPGSSVKISCKASGYTFTNYGMNWVRQAPGKGLKWMGWINTYTGEPTYADDFKGRFTITAETSTSTLYLQLNNLRSEDTATYFCVRFMSKGDYWGQGTTVTVSS

SEQ ID NO: 2024 - protein, 106 aa, Artificial Sequence
  MHC class II binding epitope
QIVLTQSPASLAVSPGQRATITCSASSSVSYILWYQQKPGQPPKPWIFDTSNLASGFPSRFSGSGSGTSYTLTINSLEAEDAATYYCHQRSGYPYTFGGGTKVEIK

SEQ ID NO: 2025 - protein, 116 aa, Artificial Sequence
  MHC class II binding epitope
QIQLVQSGPELKKPGSSVKISCKASGYTFTNYGMNWVRQAPGKGLKWMGWINTYTGEPTYADDFKGRFTITAETSTSTLYLQLNNLRSEDTATYFCVRFISKGDYWGQGTTVTVSS

SEQ ID NO: 2026 - protein, 106 aa, Artificial Sequence
  MHC class II binding epitope
QIVLTQSPASLAVSPGQRATITCSASSSVSYMLWYQQKPGQPPKPWIFDTSNLASGFPSRFSGSGSGTSYTLTINSLEAEDAATYYCHQRSGYPYTFGGGTKVEIK

SEQ ID NO: 2027 - protein, 116 aa, Artificial Sequence
  MHC class II binding epitope
QIQLVQSGPELKKPGSSVKISCKASGYTFTNYGMNWVRQAPGKGLKWMGWINTYTGEPTYADDFKGRFTITLETSTSTAYLQLNNLRSEDTATYFCVRFISKGDYWGQGTTVTVSS

SEQ ID NO: 2028 - protein, 106 aa, Artificial Sequence
  MHC class II binding epitope
QILLTQSPASLAVSPGQRATITCSASSSVSYMLWYQQKPGQPPKPWIFDTSNLASGFPSRFSGSGSGTSYTLTINSLEAEDAATYYCHQRSGYPYTFGGGTKVEIK

SEQ ID NO: 2029 - protein, 116 aa, Artificial Sequence
  MHC class II binding epitope
QIQLVQSGPELKKPGSSVKISCKASGYTFTNYGMNWVKQAPGKGLKWMGWINTYTGEPTYADDFKGRFTITLETSTSTAYLQLNNLRSEDTATYFCVRFISKGDYWGQGTTVTVSS

SEQ ID NO: 2030 - protein, 106 aa, Artificial Sequence; identical to SEQ ID NO: 2022
  MHC class II binding epitope

SEQ ID NO: 2031 - protein, 116 aa, Artificial Sequence
  MHC class II binding epitope
QIQLVQSGPELKKPGSSVKISCKASGYTFTNYGMNWVKQAPGKGLKWMGWINTYTGEPTYADDFKGRFAFTLETSTSTAYLQLNNLRSEDTATYFCVRFISKGDYWGQGTTVTVSS

SEQ ID NO: 2032 - protein, 106 aa, Artificial Sequence
  MHC class II binding epitope
QILLTQSPASLAVSPGQRATITCSASSSVSYMLWYQQKPGSSPKPWIYDTSNLASGFPARFSGSGSGTSYTLTINSLEAEDAATYYCHQRSGYPYTFGGGTKVEIK

SEQ ID NO: 2033 - protein, 116 aa, Artificial Sequence
  MHC class II binding epitope
QIQLVQSGPELKKPGETVKISCKASGYTFTNYGMNWVRQAPGKGLKWMGWINTYTGEPTYADDFKGRFVFSLETSASTAFLQLNNLRSEDTATYFCVRFISKGDYWGQGTSVTVSS

SEQ ID NO: 2034 - protein, 106 aa, Artificial Sequence
  MHC class II binding epitope
QIVLTQSPATLSASPGERVTITCSASSSVSYMLWYLQKPGSSPKPWIFDTSNLASGFPSRFSGSGSGTTYSLIISSLEAEDAATYYCHQRSGYPYTFGGGTKLEIK

SEQ ID NO: 2035 - protein, 116 aa, Artificial Sequence
  MHC class II binding epitope
QIQLVQSGPELKKPGETVKISCKASGYTFTNYGMNWVKQTPGKGLKWMGWINTYTGEPTYADDFKGRFAFSLETSASTAFLQINNLRNEDMATYFCVRFISKGDYWGQGTSVTVSS

SEQ ID NO: 2036 - protein, 106 aa, Artificial Sequence
  MHC class II binding epitope
QILLTQSPAIMSASPGEKVTMTCSASSSVSYMLWYQQKPGSSPKPWIFDTSNLASGFPARFSGSGSGTSYSLIISSMEAEDAATYYCHQRSGYPYTFGGGTKLEIK

The invention claimed is:

1. A method for preparing a biologically active modified peptide that is less immunogenic than and homologous to an immunogenic biologically active peptide, the method comprising the steps of:
   (a) comparing MHC class II molecule binding scores of sequential overlapping segments of the amino acid sequence of an immunogenic biologically active peptide, the binding scores being determined using a sum of assigned values for all aromatic and aliphatic hydrophobic side chains in each segment, in which the assigned value for each aromatic side chain in the segment is about one half of value assigned to each aliphatic hydrophobic side chain in the segment;
   (b) selecting at least one segment to be modified, the at least one selected segment having a relatively higher binding score compared to the binding scores of the other segments;
   (c) identifying at least one amino acid substitution within the segment selected in step (b) that substantially reduces the calculated MHC class II binding score of the segment; and
   (d) preparing, by recombinant DNA techniques, a modified peptide that has the amino acid sequence of the immunogenic biologically active peptide, but differing therefrom by the at least one amino acid residue substitution identified in step (c), the modified peptide being less immunogenic than and having substantially the same biological activity as the immunogenic biologically active peptide.

2. The method of claim 1, wherein the amino acid sequence of the modified peptide has the same number of amino acid residues as the amino acid sequence of the immunogenic biologically active peptide.

3. The method of claim 1, wherein the immunogenic biologically active peptide is a protein selected from the group consisting of: sTNF-R1, sTNF-R2, sTNFR-Fc, protein C, acrp30, ricin A, a CNTFR ligand, subtilisin, GM-CSF, human follicle stimulating hormone, β-glucocerebrosidase, GLP-1, and apolipoprotein A1.

4. The method of claim 1, wherein the immunogenic biologically active peptide is an antibody selected from the group consisting of: anti-40 kD glycoprotein antigen antibody KS 1/4, anti-GD2 antibody 14.18, murine anti-Her2 antibody 4D5, humanized anti-Her2 antibody 4D5, anti-IL-2R (anti-Tac) antibody, anti-CD52 antibody, an anti-CD20 antibody, and an antibody directed to the human C5 complement protein.

5. The method of claim 1 wherein the immunogenic biologically active peptide is anti-40 kD glycoprotein antigen antibody KS 1/4.

* * * * *

UNITED STATES PATENT AND TRADEMARK OFFICE
CERTIFICATE OF CORRECTION

PATENT NO.       : 7,430,476 B2
APPLICATION NO.  : 10/468496
DATED            : September 30, 2008
INVENTOR(S)      : Francis J. Carr et al.

It is certified that error appears in the above-identified patent and that said Letters Patent is hereby corrected as shown below:

<u>Column 5,</u>
Line 61, "MIC" should be -- MHC --.

<u>Column 9,</u>
Line 22, "(- - -)" should be -- (———) --.

<u>Column 14,</u>
Line 43, after "to the" delete the comma ",".

<u>Column 17,</u>
Line 49, "Sp3 - Sp2" should be -- $sp^3 - sp^2$ --.

<u>Column 23,</u>
Table 2, col. 3, lines 1, 5, 6, 13,
    "A C D E C H K N P Q R S T" should be -- A C D E G H K N P Q R S T --.

<u>Column 24,</u>
Table 2-continued, col. 3, line 4,
    "A C D E C H K N P Q R S T" should be -- A C D E G H K N P Q R S T --.

<u>Column 26,</u>
Table 4, col. 3, line 1,
    "A C D E Q H K N P Q R S T" should be -- A C D E G H K N P Q R S T --.

<u>Column 27,</u>
Table 4-continued, col. 3, line 8,
    "A C D E Q H K N P Q R S T" should be -- A C D E G H K N P Q R S T --.

<u>Column 29,</u>
Table 5, SEQ ID NO: 129,
    "WRFIFIDTSCVCT" should be -- WRFIRIDTSCVCT --.

UNITED STATES PATENT AND TRADEMARK OFFICE
CERTIFICATE OF CORRECTION

| | | |
|---|---|---|
| PATENT NO. | : 7,430,476 B2 | |
| APPLICATION NO. | : 10/468496 | |
| DATED | : September 30, 2008 | |
| INVENTOR(S) | : Francis J. Carr et al. | |

It is certified that error appears in the above-identified patent and that said Letters Patent is hereby corrected as shown below:

<u>Column 37,</u>
Line 6, "(WT—wild type)" should be -- (WT = wild type) --.
Table 10, col. 3, line 1,
    "A C D E G H K N P O R S T" should be -- A C D E G H K N P Q R S T --.

<u>Column 47,</u>
Table 15-continued, SEQ ID NO: 588,
    "VPLTIKDPAVGPL" should be -- VPLTIKDPAVGFL --.
Line 67, delete "35".

<u>Column 48,</u>
Line 55, "bums" should be -- burns --.

<u>Column 51,</u>
Line 41, delete "35".

<u>Column 65,</u>
Table 23, SEQ ID NO: 1316,
    "SILAGSCLYCGLP" should be -- SILAGSCLYVGLP --.

<u>Column 89,</u>
Line 55, "Seine" should be -- Serine --.

UNITED STATES PATENT AND TRADEMARK OFFICE
CERTIFICATE OF CORRECTION

PATENT NO.       : 7,430,476 B2
APPLICATION NO.  : 10/468496
DATED            : September 30, 2008
INVENTOR(S)      : Francis J. Carr et al.

It is certified that error appears in the above-identified patent and that said Letters Patent is hereby corrected as shown below:

Column 90,
Line 6, "seine" should be -- serine --.

Column 95,
Line 44, "seine" should be -- serine --.

Signed and Sealed this

Thirtieth Day of June, 2009

JOHN DOLL
*Acting Director of the United States Patent and Trademark Office*